United States Patent 8,101,359 (METHOD FOR DETERMINING RISK OF RELAPSE OF BREAST CANCER FOLLOWING TAMOXIFEN ADJUVANT THERAPY) - sequence listing, part 2

SEQ ID NO: 594 - DNA, 5087 bp, Artificial Sequence
  chemically treated genomic DNA (Homo sapiens)
ttttgaaatgtaaaataaagtattttatttatttttaagtgtattattatttaatattaaaggttttttaaattagtattaatagggtgaaaggagattttaaaaatagaattgtatatatatatttgaaagatatgtaaattaaatttggtaatagattatttgtaattggatttattatatttgtaaatgattagttatttattagtagtattaatataaaagaataataattagtgtataatattatgttttagaaagttaaagttggttaaaaggaaatttttttataaaattttttatatagaaataatttagtttttgataaatgaaatgttatgttttttttgtttgtatgttgggttaaaataaatatggtttggttttaaaagtttgatggtattttgtaatgttttggttttgagtttttaaaatataattttgtaattattgtttatttaagtaagtatatgtttgttattttaaagtattgtttaatatattgatattgttttgtttatttataatataagattttaaatagagtattttttttttatattttattattttagtatgtaaagtagtgttttttaaatttgtatataaaaaaaattgtagtgaatagtaagtaataataagaaaatggtgtaatgtagtgataggtgtttaaatttatagtttaaatattttttatgtgaatttaattttaattttgagatttttaagaaaattgagttattgaagtgtttaaatttttaagatggtgttgtttttggttttggttggttattttttaagttttattttttttgggggaatggtgttttaatttttttttaagataagtatttttggtaaatgttttttttttaagaaagaagtattttataaagtttttaatttgttgtgtattttttgttttattgggttatagtggatttagtgtgatgttgtatgttttaaattggggttggttttgttttggaatttggaagatttggaaagttaaaaaataaataaaaaaatagtttttagggaggtatgttttaaaaatagtatattttgtgtttatttttgtgtttttaagagtgaggagaggagggaagaagaagggaggtaattgtttttgtgttgtgttttgttgtttattttttttggttgttttggggagtgtagtggtgtgttggggttggggttgagggttggtggttgttgttgttaatggaattgttatttttggatgtgttgggtgtgttttgttttgggtttttattttaggtagttgagatagggtgggtagatttgtggtaggttttttttgagtatggtggtttggtagttgagttgtgggagtttgttgaggttgagtgtagggtagagtgtgggggttgttttggtggtggtggtagaggtggaggtggagggtaggttgttttgtgggagtaggtagttgtttgtgtttggtgttttgtagggtggtggtgtgaatgggttttgttggggtggtgtgttttttgttttgtataggatgtattttagggttgattttgaggaggatgtagatgagattgaggtattggtgggtgtggttgttattgttgtttttttgggtttggatggggttgtttgtggtggtagtgggggtggtggttttaatgggaaatttgggaaggttgtggggttggtattggttataaggtaggaatgtggggagtgtgtggaggtttttgtgttttttttttttttttttatttttagagtgggtggttggaagttgttatagagagggtatgtgttgtttttgggtttggtgttgggtgggtatgtgtagttggggaagttgtttatagtgattggggtggatgaggtatagggtgaattttgtggtggggtaaaggtgttggtagttttggttttgttgttgtaatttttgttttttagtagttgttgagtgtgggttgttaataaggtgtgattgagaggtaggataggtatgtggatgaaatttattattgtggtggttagtggggagtgtttgggtgttattggtgtgttttgttttattagggtgattttgggtgttgagaagtgggaattttttttggggattagggtgatgttttttgttgttgtttttggtgggatagttgtggttttttttttagttgttgtgttatttagagtttgaggtttgttttttagaagtggatttgtagattttttggatttagagttatttttttttttaatttttattgtagtggtttgtggagatggttttattggggttttggattagtgagggtttttagaggttgggagtagtagttgttgggttggtgataggttttggggtagtattttatgggtagttgttgttttggagttgtttttaattttgtatttggattggtttatgagtggggataatatttgttgggtggtgggggtagttggtggatttttgggaagtttggggttaaataggtattaagagttggtgattttgtaggtgggagggttgggttggttttgtttgggatttgagggtgttaatagagtgtttaagatattgtttagtagtttgttgtttttttttgggggattagaattgttgtttttagtattttttgtagttttagttttggaatatgtgttttttatgtttgatagtgattgttggttttgtgtttttttgttggaggggttttgtttttggtagggttgagggaagagtagtttgtttagggagataggtatggttgaaattttaggtaaggtgtttgaggtttggttttttgggaatggatttgtggttgggtgatatagtagtggggatttgattttgggggagggtgggttgtttgttatgtggggagtttggggattttttgtttttagtttagttatgatgattggattttttttttttttttttttgtttttaggaggagggaaaagggaaggaggagggggttttgggaatataggggtagagggaggagaaagtgggtgttgaatgtggttggattggagggatttttattttttgggttgggggtgggggagggtggtgttggttagtttttgtttttggtttttattttgttgttaggggaattgtggttgttgtttgttttagtgagtggtaagtggggagtgtaagaaaaagtagtaattgttaggagattttgttttttaatttggggagttttttaagagagttttttaatttttgtttgaggattggagatgtagagtatttataagtttggtatttgagtggttgtggttgtgatggtaatttagtgatatgtggtttttttattttttgattttttttttggtattaaatttgtgtatgttgtgaagtttttagttttttgttgagttttattgtttttttattaaaattttggggttagttggattttttggtatagtttatttttaggaagggttggatttttgttggttttgtattgtgggtgatagttatttttgaagattttagattttagtagtgtgggagtattagttgttttgggttgtagattttatttaaatgataagtgaagttagtttttattgagaatgttatttatatgtataaatataataaggtttattttgattagtgatagttgtggattggttagatagttttttaataatgtttttttttttagggaggttttgtttaaagtttttttttattttaattattggtaggatttgaaattttggagttggtatttttatttgttattttgaatgttatttttaatagtaggttttttgggatggaattttataagtatattatgttttgttttgtaaattaagaattatgttttatttaattggaaaaatgaatagattttattagaagtagaatttttgttattattttaagattttagttttgtaaagatttaatatagaggaagatatttggttatattattttttaaaataataaatgtattaaggatgatattaaataagagatttttttttttatgagttttataaaagtgaatgtttttaagttttttttgttgtgattaatatgttttgttttttttgagtatttttagtgtgataaagaaatttgggagtgggagatggtaatatttttgtatttatgatggaagtttggatgttgtgtgttatattttgatttgttttaaggaatgtgttttaatttttagtaaatagtattttaaggaaagttttttttagttttagtttatatagtgtgttatattataatatttttagtagagatgttgaatagtattttttattttaaatatttttagtttgaaaagtaattatttttgagtttataaaatggatttttgttaaatttatgaagttagtagaaaaagggaagaatattgtaatatatattttagatatatagttataaattgtatttgatttaagattattgggtattttaatattattttaaatatattttgtttaaaatagagtgaatgatttgtaaatttttttgtaggattttaaggtttagttgtgttaatgatttatagtttattttaattatgtataaagaatgtagaagattttagaaggtgggggagttattagaggtaaggagtttggattttttgattatttggggaggggttatatgagtgagaaataaatttttattatgttaggttattaggatttggagttggttgttttagtaaatagtttattttgattaattttagatatgtggaagttaggtagatagaggaaaggtaaagagaattttgggaagtaggtatagaatgtttattgggtattaaatggtaggatataatatggtaattgtaaggggattattatgaatagaataggagtaagtgtgggtatagaagtatatgagattagagaagtaaattaatttattaatattattattgttgtttttaggttttttttttttagtttattttaaaatagttattatgttttattgaggtgtaattttagtattatatagtttatttaaagtattagtttattgattttttatgtatttagagttgtgtaattattag

SEQ ID NO: 595 - DNA, 7110 bp, Artificial Sequence
  chemically treated genomic DNA (Homo sapiens)
tgttttttgtgatgttttagaggttagaaggatgttttgaaggggaaaattgtaggagttaggtagagtagggttttggtttttttttaatgtttttttatttagataaatttgggttattttgtagaggttgtagtgagttatgattatgttattgtattttagtttgaggaatagagggagattttgttttaaaaaaaaaaaaaaaaaaaaaaaaaaaaaaaaaaaaaattttggtttattttatgaagtatttggtaggtgttttaatattttttggtatatgggaattatttttttttattattggaaggtttaaaaagtaaataatgtgttttatatggttagagttagtattaaggggattaagtagaataattggtagttagtgttagtttggagattaatatagttaaagttgttttgttatgttatgttttttttatttgtattgttttatggtttaagataaaatttttgaatgttatttggatatagtgagtatttggtttgttttattgtttttaggagtaattaatttaatttttatttttttgagaatgatgattttatatagtatatttttttattaagatgtgaaagatgatattatggtatttgaaatagttttaggagagatttgggatatgggaagtttgtagataataatggaaaatttttttttagaatatagttatttgtatgatttatagtagtgttttttggagaatgttttaaaattatttttattgaaagaataataatgtttgttattaggataaatgaaataaggggaaaattttagatttttggaataatgggtttatatttaatttaatgattattatgtttttatattttgtattatttagaaaatagtagttaaatagatagaaatatagaagattgtttaaaaattaaagttattgagttagatttttttttgaaaggttagtgtatgggagatgagaaaggtattatagagattagagtgtttatataaaagatattttagtagatgatttataaagagtatattaagtatttatattatttatattaagttgttggttattttgtttattaaagaaaataagaaagaaatttttttttgatattattttggtgtagtaataatagagttttggaattagttgttagaagtgataattaaagttagtttattatgtttattaattaatttatatagttattttgaagttttatataattgtttttttgttataagtttttatttttttttatggtattttggttttgaatttagataggtaaagaattaagtatggttgggtgtggtggtttatgtttgtaattttagtattttgggaggttgtggtgggtagattatgaggttaggagattgagattattttgattaatatggtgaaattttgtttttattaaattataaaaaattagtttggtatgatggtgtgtgtttgtagttttagttatttgggaggttgaggtaggggaattgtttgaatttgggaggtagaggttgtagtgaattgagattatgttattgtattttagtttgtgagattttgttttaaaaaaaaaaaaaaaaaaagaaaaaaaaaaaaagaattgaagtgtttggagattagtgtattgtaatatttatatagttaagtaggtatttttaattgaattttaaaaaagtattatttttgaaattttttttagtttagatagggttagttatttgggtagaaaggaaaagaaaaataaaaaattggaaaaggatgtattagtattttttttagaaataatttaatattaggaatagaaggaggattttatttattaatttttaataattatttgatgttgttgttgggttggttaaatatttgttaatattgatgatttttttatttattattagagagaagtagagggatttgatgtttagagaagtagtaaaatttattttttattttttttttttagttggatggaagtatttggaggttggttttatattttagtattttagtgttggtgatgtagattatttttgttttagagtaattttgtgttatggaatttaagaggattttgttgtattaggataggaatgtatttttgttttatttgtttttatgaaagtagattttagagatttttagatgttatgagattaattgttatttagggtaggttttaggggagggatagagaagggtagtgttaataatagggattttggagataagattagtaatttaagaaataaatgtgagatattttatttttttttaatttattttttttttaaaagtttatttttattttttttttttttattatgtagtaattgataattaaatatagttttggtttttattatgtaatttagtagaatatttagatattaggaattttttatttttggttatttatataataatgaaatttgtagtttatgttaggttgtgtggatagtatttgtatttttggaaattaattggaggttttttttttatttttttttggttgttttttatttttttttttattgtggtttttgttttttttaagttgattagaattatgtataaaattagtttttaataaatattaatattgaagttttagtaggttgttaatttttgtatagttattttaaatgttgtatataagtgtaaagttttatggagttttagaggtttttaagaatattgtaaatattttaggtttaattagtagttttggagttaggtaatggtttgtggttttttgtgttaggttttttgaggtttttagtttttagaggttgtttgtaattatgatgtgtatatatatagtatttttttttaaatatagtataaattttttttagattttgttaggtatttataattattgaatatatatgtagattgatttttatttttttaaagtttgaaaaataatttagtgttttaatttaggttttgttagatattttttgatttaaattgttgtttgtagttttattttttaagggaaatgaaaaaataataaatttttagattggtgttgatgtttattttttttaagtgggttgattatttgttttgtagatttttgatgggtggggtgtggggtaggagtgtgatttaatttttagtatttttgaattagtttttttatggtgataggttagtttaattggggttgtaaatagatttgataggtttgttttgggttgatggttattgattaggtttttagattagataagttatttggttgagtttatagtaggtggggtgtgtttattagtttaggggtagtgattggatgtttgttgtaatattggagaatgtatgttttgggttgtagtaggagatatttttaagtatagaattaaaagggtttattttaagtggtagggtattagtgatggagaggtttgagagttttagtgtttagtttttttttttatgtttgggaaggtgtagaataggttgatgtagagtaaggagtgagttttaggttttagttttttggtttgtttttagggtagtaggtgaggagtggtattagtttggggattttttttttgtgttttgtaagaattggtggtagttagtaggtggggaggtgggggtatgtgtttggatgtgggtgtttgtgtaattagttttttaagtgttagttttgatagtgtttttttgggaggttggtttgagtttttgtttttgttgtggtgtaggaagggttggggttttgttgtttgtattaggtaagagtattttgagtaaaggaagaagatgatttgtttttggagttattattggggagtgggaatttggaaagttttttaattagggatatatgtgattttttttggaaagtagttttgattgtggtttgtgtatttttttatttttttttgaatttttttaggtttttttgttttgtttatttgttgggttgtagttttttattgttttgtattttttatttaatttggtaattttaaatgtgtatggtttggttggggtgtgtggagtttggttttgggtgatttattttgttgggtttttatggtggttaagggggggtggggttaggtggtttttgagaattgagtttgattttgatgttgtgaattgatttggagtttgaggggaaagatgtttgatttttttgggggtattggagtgggtgtaggagaggtttgtggggtgtgttttatttatagggatttttttttagtttatttagataggtgttttttgggtttttgaaatttaatggttatgtgtttatgtttagtatgtttggttgagagtttttatttttagggtaaatgagttgagttattggggaagtgagaggtggggtgttgtaagggagttggatgaggtgatatatgttggtgatataatagtaggttgttttttgtgttaagattgatattatgaggatatagatttgggggaagggggaatttttaggtaaaggttgttatagttaaatttttgtgaatgattgtgatttgatagtggtgtaaaaggaaagagtgaatgtagtttatgttgtggaaatttaggggtagaggtaaggggggagggtattttttttgtagggattgtttttgtatttttttttatattgagtagtgtggttatttggttttttttatttgtgtataggtaattttagatttgagttagtgatattgtttaatgtatttattttagtttttattattagttttttatttttgttttataatagtttattttgtttttggttgggtttttgggtagaggttgaggtttagtttgttatttttgttttgtgttgttgtaaaagttgtagtaagtgtagttgtaggttggtggttgggaattggtttgagtaagttttaggtagttatattgggtatgtttagtagagtttgtggtttggggattttgtgtttgtatttagagttattgttttgtttttttttattgttttttgttttgttttgttttttttttgtttggtgtggttttgtttgttttttgtttgttttttgtttttttttggttttttgaggtgtttgggtttttggtgtggtggtggagggggtgggtaggttggtgggtggtgatgtggtgggattttttatgtgttgtggtaggatatgtgtttggtgttgggatgtgattgtgtttagttttttttttttggaagttgtagttatgatggaagtttgagagttgagttgttgtgaggtgaggttgggtttaggtgagggagatgagagatggtggtggttgtggtttggagttttttttagtgtttgtgagtagttgtgggggtagtgtttttggggagttggttggtttgtggtggtggtagtggtggtgttttttgttttttttttgttttttttaattgtgtagttttttttttggttttttttgaaagggaaggtggaagttgtgggtttgggtgggagttggttgaggtgtggtggtggtggtggtattttttgtttttggagtgggggggagaagtggtggtggtggtggttgtggtggttgtagttttagggagggggtttgagttgtttgttattatttttagggttgggaatgttggagagttggtttttttttttttattgtttttaatatggtggtggtggtggtggtatatttagggatttgggttggttttaaattttttgtttgttgttgttgtattttttgtggtttgggttttggaggttgttggtggaggtagttgtttggaggattatttgttttttttttattttgttgttgttgttgttaggtttttggttgttgaggagaagtaggtttagttgttgtaattatttagtagttgttgtagtagttattatttggttgtggtttagagttaagtggtggtagagtgaggggtattagttattgttaagtttagagttatttttattttgtagaagaagttttgttattagtagtttttgttatttttttttttttttttttttagttataggtttttagatatgatagttattattaaagagattgttagtagaaataaaaggagatattaagaggatggatttgatttagatttgatttgtatttatttttgtggttgtttttttttatttttttgttatttttttagaatgtgggagtagatggatgtgaaaatgtttgtagtttgggtgattataatatttaattttggttaggttgttaggttatatattttgtgttttttttttgtgtatttaatttagggtgtgtttggttagatggaatttttgtttggttgtaagtgttaagttattgattgtttttttaggttatttatatggtttttttttgagggttattgtttgttaatatagaatatagtatattgttagtggattagtgagtttggtaatttggttttttaaatgaataaaaaagtagatgttttttgaggttgagtatattttgattaaattttggtttaggttttagattaagggtttagattagaataaaatgaaaattagtgttgtatgtatgtatattgtattagaattttgtagtgattgttttagttttttgagttgtattgatagatttttttaaaatatgattgatttgtataattttagaagtagaattatttttagtatatatggtgtatattgagggtaaaaagtagttttgttaatgtttaaatttaagttatttataattttgaattgtatgtagaagttttgtagtttgaagttaatagtgttataatatattttataaggtgtttttattagatttttgttatatttatttttttttttttttatggggtgatgtaggatagtgtttgaaatttgtattttagtagtatttaatgtttagtgtttttgttataaatatagaatggatattgagtagtttttgattttagatggtaatgtgtaggtttaagggtattgtgtgtagtaagtgaagattgtagaaataaaattttagtttatgtttgaaatttaagtattgttgtgatgttagaattgttgtttattgtttttaggttttaggttttttgatattttttggtattgttaattttattgatttg

SEQ ID NO: 596 - DNA, 7110 bp, Artificial Sequence
  chemically treated genomic DNA (Homo sapiens)
taaattagtaaaattaatgatattaaaaggtgttagaggatttgaaatttaaaaatggtgagtagtaattttggtattataataatatttaaattttaagtatgaattgaagttttatttttgtaatttttatttgttatatataatatttttgaatttatatattattatttgggattagaaattatttaatatttattttatgtttatgataagagtattgaatattaaatgttattgaagtgtaaattttaagtattattttatattattttatagggagagaaaaaggtaaatataataaagatttagtaagaatgttttataaggtatattatggtattattgattttaaattataaaatttttatatatagtttaaagttgtaggtaatttaagtttaaatattaataaaattattttttgtttttaatgtgtattatatatattgaaaatgattttgtttttaaagttatgtaaattagttatattttaaaagaatttattaatgtaatttaggaaattaaaataattattgtaagattttgatgtaatatgtgtatgtgtaatattaatttttattttattttgatttaaatttttgatttagggtttaagttaagatttaattgaaatatgtttaattttaaaaagtgtttatttttttgtttatttaggagattggattattgagtttgttaatttattaatagtgtattgtattttgtattaatggataatagtttttaggaagagattatatagatagtttaagaaagtaattggtggtttgatatttgtaattaggtaagagttttgtttagttaaatatattttaggttgaatatatagaaaggaaatataaaatatatgatttagtaatttgattagggttaaatgttatagttatttaaattatggatatttttgtatttgtttatttttatgttttaagagagtgatagaaaggtaaagaggagtagttgtagaaatggatataggttaagtttaagttgaatttatttttttgatatttttttttgtttttgttaatgatttttttgatgatggttgttatgtttgggagtttgtggttgaagaaaaaggaggagagagatggtagaagttgttggtggtggggttttttttgtaggatggaaatggttttggatttggtggtagttgatgttttttgttttgttgttgtttggttttggattgtagttgggtaatggttgttgtggtggttgttggatggttgtagtgattgggtttgtttttttttagtagttagaggtttggtagtggtggtagtggaatggggagaagatgaataattttttgaatggttgtttttgttggtggtttttggagtttgggttatggggggtgtggtggtggtggatgggaggtttaaaattggtttgggtttttggatgtgttgttgttgttgttgttgtgttggaggtagtagaaggggagagattaattttttggtgtttttagttttggaaatggtgataggtgatttagattttttttttggagttgtagttgttgtggttgttgttgttgttgttttttttttttgttttaggagtgggaggtgttgttgttgttgttgtgttttagttggtttttgtttgagtttatggtttttatttttttttttaggagaagttgaggaagaggttgtatggttagaaaagatgaagaggaggtgagaaatgttgttgttgttgttgttgtaggttggttggttttttgagggtgttgtttttgtggttgtttataggtgttgagaggggttttgggttgtggttgttgttgttttttattttttttgtttgagtttggttttgttttatagtggtttaatttttaaatttttattatggttgtagtttttgagaggagagaattgagtgtagttgtgttttagtgttgagtgtgtattttgttgtagtgtataaagagttttgttatattattgtttgttggtttgtttgttttttttgttgttgtgttgggagtttgggtgttttggaagattgaggggaggtgggaggtgagtgagaggtggatgggattgtgttgggtgaggggagggtagggtagggtagggggtggtaggagggggtagagtggtagttttgggtgtgagtgtagagtttttaagttgtaggttttattgagtatgtttagtgtagttgtttggggtttgtttgggttggtttttagttgttagtttgtagttgtatttgttgtggtttttgtagtaatgtgaggtgaggataatgagttaagttttggtttttgtttagaaatttagttggaggtagggtaggttgttgtggggtgggggtggaggattgatgatgaaagttgagatgggtgtgttgagtagtgttattgatttgagtttgaggttatttgtgtataggtgaaaaggattaggtgattatgttgtttagtgtagagggaaatgtagggatggtttttgtaaggggaatattttttttttttgtttttatttttagatttttgtggtgtggattgtatttgttttttttttttgtattgttgttggattataattgtttgtagagatttgattgtaatagtttttgtttagagattttttttttttttaaatttgtgtttttatggtgttagttttagtataaagagtaatttgttattgtgttgttagtgtgtattattttatttggtttttttgtagtgttttattttttgtttttttggtaatttggtttgtttgttttaaaaatgaaagtttttagttgagtgtgttgaatgtgaatatatagttgttgaattttaagggtttaaagggtatttatttaaatgaattgaaagaggatttttgtgagtgggatgtattttgtaggttttttttgtgtttgttttggtgtttttaagagagttgagtatttttttttttgggttttaggttggtttgtggtgttggagttaagtttggtttttagagattatttagttttgtttttttttggttgttgtgaaaatttggtaggatggattgtttggggttaggttttgtgtgttttggttggattgtgtatgtttggggttattgggttgagtggaaagtatggaatggtaggaagttgtagtttagtgagtgggtggggtgaggagatttaggagggtttaaaaggaggtggaaggatatatgggttatagttggaattattttttgaaggaggttatgtgtgtttttagttggggaattttttaaatttttattttttagtgatagttttggaggtaagttgttttttttttttgtttggggtgtttttgtttggtgtaggtagtggaattttaattttttttgtgttgtggtggaaataggggtttggattagttttttgaaggagtgttgttggggttggtgtttggggaattggttatataagtatttatatttaaatatgtgtttttgtttttttgtttgttggttgttgttgatttttatagaatgtggggagagagtttttaaattggtgttattttttgtttgttattttaagagtaagttaaaggattgagatttgagatttattttttgttttatattgatttattttgtgtttttttaaatgtgggaaaaggagttgggtgttagggtttttgggtttttttattgttgatgttttgttgtttagggtgaatttttttggttttgtgtttgagggtattttttgttgtagtttagagtgtgtattttttgatgttgtaataaatgtttagttattatttttgagttggtgagtgtgttttatttattgtggatttagttaagtgatttatttggtttgagaatttagttaatggttgttagtttagaataaatttgttaagtttgtttatagttttgattgggttgatttgttattgtgagagagttgatttggaaatgttgagagttggattgtatttttattttgtattttatttgttaaggatttataaagtaagtagttgatttgtttaaagagaatgagtattaatattagtttgggaatttattgtttttttattttttttaggaagtagaattatagatgataatttgagttaaaaaatatttaatgagatttaggttgaagtattgagttgttttttaaattttgagagaatgagaattaatttgtatgtgtgtttaataattgtaagtgtttagtaaagtttaaagagggtttatgttgtatttgagaaagagtattgtatatgtgtatattatagttgtaggtaatttttgaagattagaaattttaagagatttagtgtagaaagttataggttattatttaattttgggattattaattaaatttgggatatttatagtgtttttagagatttttgaggttttataaaattttgtatttatatatagtatttaagatagttgtgtaggagttaataatttgttgaagttttagtgttgatatttattgaagattggttttgtgtatagttttggttagtttgggaaaggtaaggattatagtggaaaaggaaatggaaagtaattggaaaagagtaagagaaaggtttttagttgatttttagagatgtagatattgtttatatagtttagtgtgaattatagattttattattgtataaataattaaagataaggagtttttgatgtttaggtgttttattagattgtatggtaaaaattagagttgtgtttaattattaattattgtgtggtagaaaaagggaaaatgaagatgaatttttaaaaggggagtagattagggaggggtaaaatgttttatatttgttttttagattgttgattttgtttttagagtttttgttattagtattgtttttttttgttttttttttggagtttattttaagtgataattagttttatagtatttgagaatttttgaaatttgtttttatggaagtaaatgaaataagggtgtatttttgttttggtgtgatagaatttttttggattttatggtatagagttattttggagtagagataatttgtattattagtattaaagtgttagaatatgagattagtttttaagtatttttatttggttgaagaaagaaaatgggaaatgggttttattgtttttttaaatattaggtttttttatttttttttagtggtgaatgaaaggattattaatgttggtagatatttggttagtttaatagtaatattaggtggttattaggagttggtgaataaaattttttttttgtttttagtgttaagttgtttttgaaagaaatattgatgtatttttttttaattttttgtttttttttttttttttatttaaatggttggttttatttaaattaaagaaagttttaaaaatagtatttttttaaagtttagttgaaaatatttgtttggttgtatagatattataatatattggtttttaagtattttagttttttttttttttttttttttttttttttttttttgagatggagttttataggttggagtgtagtggtatgattttggtttattgtaatttttgttttttaggtttaagtaatttttttgttttagttttttgagtagttgggattataggtgtatattattatgttgggttaattttttgtagtttagtaaagatagggttttattatgttggttaggatggttttgattttttgattttgtgatttgtttgttatggttttttaaagtgttgggattataggtgtgagttattgtgtttggttatatttagttttttatttgtttggatttagaattagaatattatagggagaagtagaagtttgtaataaagggataattatataaagttttagggtgattatgtagattgattagtaagtatggtaaattagttttaattattgtttttaatagttgattttaaaattttattgttattatattaaaataatgttgaaagaaaattttttttttattttttttgataagtgaaatgattagtaatttgatgtggatgatataaatatttgatgtgttttttgtaggttatttgttaagatgttttttgtgtaaatattttgatttttatagtgttttttttattttttatatgttgattttttaaaaagggatttaatttaatagttttaatttttaaataattttttgtatttttgtttgtttaattattgttttttaaataatatagaatataaaaatataataattattggattgaatgtaaatttattgttttaagggtttgaggttttttttttattttatttattttaataataaatattattgtttttttaataaagataattttaagatattttttaaaaggtgttattgtgggttatataagtaattatattttaaaagagaattttttattattgtttataagttttttatgttttaaattttttttgaagttattttagatgttatggtgttattttttatattttggtagagagatgtgttgtatgaaattattatttttagagaaataagggttgagttggttgtttttgagaataatagagtagattaggtatttattgtgtttaagtggtgtttagaaattttgttttggattgtggagtaatataaataaaaaagatataatatgataagatagttttgattatgttagtttttaggttaatattagttattaattattttatttggtttttttaatattaattttagttatatggagtatattgtttgttttttagattttttaataatagaaaaaggtaatttttatatattagaaaatattgggatatttattaggtgttttatagagtaggttgaaattttttttttttttttttttttttttttttttttttttgagatggagtttttttttgttttttaggttggagtgtagtgatgtgattatggtttattgtaatttttgtagaatagtttgaatttgtttaggtagagggatattgagaaggagttaaaattttgttttgtttaatttttataatttttttttttaaaatatttttttggtttttaaggtattataaaaaata

SEQ ID NO: 597 - DNA, 6478 bp, Artificial Sequence
  chemically treated genomic DNA (Homo sapiens)
tttattttgaagggatgtttaagaaatattgttaaatttaaaagtgttgtagagtaatatgtattataagattatattggtataatagtaataaatagtatttttttatataattttaaaaaaatatatagatttatgttaagtattagttaagatgtttggtatatggtaggtatttaatatttaatgaatatatgtagaggatttttattttttattttatattttttggataagattttgaatttttatgagtatgtattatttaaatttagatttatagggagtgatggaaaatgtgaaaataaaattttaaaaaggaaaagaaagagtaaagatttagatttaaaaaaggaaatgtaaataagatgaaatagttaaagataggtttttttaaaattaatgttgagataatgttattagtagtgatagttagttaagagatggtttgtagtttattgtttagtattgaggtatttagtaggggttgtatttaatttttaagttggaattaattgaaattgttgggtttgaagagttgtttttatgagttattgatggtagaaagtatagaagtattaaagaaaataatttagaaatgtggaaagagaaaagtatgtttttgttttgggagaataatatttgtgtgtaattaagtaggaagattttgtggaggaaagtttgaaaaagtagagagttgaagagaaaagagttaaatgaaggatatggtggttaatatttaaagtaaaaagatatttttgaagaagatgtgtttttagggtttttaagaagttgttatatttatgtttagagttattttgtaagtttatttggaaagtgtattggtgttttttggtataagatttatgaatattaatagttttgttatgtgagtaggtgtttatattgaagggttataagtaaagtttttatgtgttattattgttagaattttttttgtttttttttaatataaaagtagttttgtttgttagtatggaagttttgggaagagttttatatttgttttgtgttgttaatatttttgttttggtttttttgttggaatatataagttatttagtattagttatttatttttttggtagaattgtggtaagaggggattaatagggaaaaaaaattaaaaaataaataaaaagttaaaataatatgaaagagttgggtatgtttttaaaataattagtgtttattttttttagttttgtgtttgtgtttgtttgtattttgtatgtttgtttttgtggtggggggggatatgtttgtgtttttgaaaatttttttatttagatattataaggtattagtttaattttgaatatagttggttgtagtatggtgtatagatatgattgttttttttttagaaaattttttagtttaaatatgtttgtagagtatgatttatggtgtttttttttggattgtttagtgggtaattgttgtatgaaaattagagaaatagatgtagattttgaattttggttataaatttttgttttatgattatgggttttaaatgtgttgtgttatattgataaatatatagttattttgaaataaaatggattttatttttaaagttttgttttttgttttttattttttgtttgtttgttggttggaaatatatttattagattattgattaaatataaagaaaatagagatgatatatattagaatgttattttatgttataataagaagatatttgggaaagttttttttaattttgtggttaatgtttaaaatgggtgttagtagtttatattttattatggataaattggtttattttttattttttattttatttattaatttttatagtgtatggatttgtatttaaagaattatggtttatttatgtattttttttttattttatttaaaatgaagaatttggagatagaattaagtttttaagaagtgtaagtatttattgatgaagaaataattagtatgtggttaaattatgggtttgttttataaattaatatttggattaagtaatagttttaattattgttattagtataattaatttatgatgaggaatgattaattgattagtgaatattgttatattataagaaatttatattattttttttatggggatttaaatattgattatttattttaaggtttaagtttattttttagttgagaattttaaggtaattatatattttatatttttttgtataaagaaagaaaatattgagttgtttaatttttattatatatagagagagatatattaatgttgttatttttgtgtaatgatatagtatagaggtaagaaatttggaagtagtggttttgtttaatgaggttgattttatagtttaagaaatgagaatgaatagaattttgaggatatttatttttatttttatttttttgggattagtgtatttttattttttggagagatgttaagtaagaatgtgtagtagttttttttggataatagatttttgtatatatatatttgttagtgatgttatgttttttatttttaatttaagttttttttgttttatttttaatatagttgttttttttttttttgtttaataattttttatttatttttattgtttggtaaaaatgaatttagtttttaaggaattttaaggattttaaataagtatttggagttataagttttatggattaagtagaaattggtatataatgtagtgttttgtgtatttttataattattttaatgatagtgtgttaaatgttttgtaaatttttttgtgtttttttgtttaaaatgtgtgttttttttgtagttaaagggttttttataataagtttttgttataaaatgatggttatataaaagagagaagagaggtgtaaaaataataaatatagatttagtaaaaattttatttttttattgttttgaattttttaatagtaagaattgagtttgttgggttgaaaattgttttaatgtatttttataaaaggatttttgatttggtaagtgtgtgtgatgtatattttttatgttatattataagtgttatttagtaattttattagatagggtagtgttttagtatggggtggggtgttttttgataggtttttaaaaggtttggatgttaatgtatattttaatattatttataaaaaggagattggagtagtgtttttttttgtattgggtaaggagattttttttttttgtttaattatttgtttgttttgttttgtgggagaattataagtaaatgttatagaggtagtggagaaaaaagggtgttttaatttttttttagagttttttttatttgatgtatgttgtattttttaaataagttgtgtaaaatggttgtagggtagattggtttttttttttaaagttttttatttggttgggtttatttgtaaatattgtatttattttttttagtgttttaggattggttggaaagatttttttttttgtaggttgggttagtgtgagagatttaaaaaattatttttttttaaaattattgtattttaataaaaggattgggtaggggttggaatgagagaaaattggttttttaaaatgtaaaattgttatatttaaattagtttataaaatatgtgtttaattatgtggtgggatgtgtgtaggtgtatgatgagagaggtaattaatatggttatttggggtgtaaggatgtgggaataggtaagtaatttttatattggatttttattttagggagttgggttttagttatagttttgagttgtgtgattttgggtaggttttatttttttggggttttgttttattagttgaatagtatgaggatgagttatagttaatatttgttttatgatatttatttagtattatataagtgttatttttgtttttttagttaatattgatgtgggtagtattatatgtttattttatagatgaggaaattgaagtttgaagaagttaaatatttattttagaatatatagttggtaagtggtagatttggaattggaatttagtttagtttgattttttaatttatgtttttgattattatattgtttttttaagtttagatttgaaattttattttttgtgtggttgtgtgtttgggataggggtaattaatttttgattattttatatgttgtatagaatttggagaggattttttaaagtaaatgaattttgaaagttggattgtagagtaaatgagtgtagttaatttagttaggggtttgtaagagggagaaagagaaaaagattgtggaatggaaagttttttaatttaagttttttttaaggggtagttattttttgttttatagtttagggtttgtatgtgttttttttggagtggaaaaatatataagttataaggaatttaatagatagaaaggtgtatagaggaatttaaagtgtgggttggggggtgaggtggtgggtgggaggtgagtgggtgtaggtggaatattgttttttaagttaagttgttgtaaataaaaaggtgtaaagggagagaagttggtgtttaatgtgagttaggagtagtgttttggttttttttttgtttattttaaaagtattttttgtattgtttttaaggtgagaaataggaaagaaaatgttggtttgtgtgtttgttgtttgtttttttggttgtttgtttttgtagggttgttgggagtttttaagttttgtgagaattttgggagttggtgatgttagattagttgggttatttgaaggttagtagtttgggtagggtttattgaaagtttatttgtatatattaggtaatttaattttttattttgtgtgatagaagtagtaggaagtgagttgtttagaggtaggagggtttattttttgttaaaggggggattagaatttttttatgtgagttgtttgaggattgggatgttgagaatgtgagtgatttgagtagggtttgtttgggtattgttggggtaggatttggaatgtatttggaaggttttttgtaagtatttatttggaaggagaatttgggatttttttgggaattttttgttttggttggattggttgagtaagtttggaaaatggtaaatgattatttggattaattataggtttttagttggtttgtttgttataatttatgatttggggttgggaaaaagattaatagtttatgtgttaaaaaaggggtagagtttgatggagttgggtggatttttttatgttatttgtttttatatttagaggataagtatttttgtagatatttagtgtaagggagattatgtttgattgtatggatgttttgttagtgagttttgggtaaattttggatttttatattgtgagtttgtttttttgtatgttttaggagaaagtttttaaagtatgttttagtggattgatttaaattgaatggtagtattggtatattgtttaatgtaggtttatttttttttttttttttattaagaaaaaaaaaattgttttttttgtatgtaataaagatgttggaaataaattgtattggtagtaagataaaggatttaatgatttaatgttgaaggggtgtgatatgttggtatgtatattgattttttttgttgaaaattttttgttagatgttttttttttaaataattttttttgtttttatgtttttttttttattaattttatagttttttgaaaatagtttttaaaatatgtataaaaatgtggggggtggggagtagagggtgattataagattttaaaatattttttaagtagggtaatttgatatattttgtagtttttattaaaatgtatgtagagtggaatttaattttgttgttttttggattagttattagttgtataggtttttttattttttgtgtattttaatagtttaaagtaattaaaatatgatattttttttgaaaggaatttagtttaattaaggtggttgttgtttttgaagtttataaattattagtttaagttgttgtttttaatgttttttttgttaaggaaaggtaatattttttagtattgattttgttgttatttttttaagttattttgttggtttaagaagttgttgttttgttagaaaattattggtaatgaatattttttggattgagttatttattatttttatattttgtagtttagtttggaatgtggatattagttaaaggaaaggaaatataagtggggtagtttaatttaaaaaaaaaatattgattattttgttatttgatgttgatatagtgttgaggtatgtatttggttaatagtagtttggttgtaggtttgagaaatgattaggagttttagaaaattttatttttgggtggttgtagtgggagtttgtaggatgttttgttgttttgatagtgatttagataaatggtttagttatttattaaaatgtttttagtattttatttg

SEQ ID NO: 598 - DNA, 6478 bp, Artificial Sequence
  chemically treated genomic DNA (Homo sapiens)
taaataaagtattaaaaatattttgatagatagttgagttatttatttaaattattgttagggtggtgaagtattttgtaggtttttattatagttatttgaaggtgggattttttgggatttttgattattttttaagtttgtagttaggttattgttgattaggtgtgtattttggtattgtgttagtattagataataaaatagttaatattttttttttaaattgggttattttatttatatttttttttttttaattgatgtttatgttttgggttgaattgtaagatatggaaataatggatggtttagtttaaggggtgtttattgttagtagttttttagtaaaatagtaattttttagattaataaagtgatttggaaaggtggtagtagggttaatgttaagaaatattgtttttttttagtaaggaaaatattggaagtggtagtttgaattggtggtttatgaattttgggagtagtagttattttaattaaattaaattttttttaaggaaaatgttatattttaattattttggattgttggaatatataaggggtggggggatttatataattagtagttaatttaaagaatagtaaagttaaattttattttgtatatattttagtaaaaattgtaaaatgtgttaaattgttttatttgaagaatgttttaaagttttgtggttattttttattttttattttttatatttttatgtatattttaaaaattgtttttaagagattataaggttggtaaggagaggagtatgggggtgggaggggttatttgggaagaaaatatttaataggaaatttttagtaaagggaattaatatgtatgttagtatattatatttttttagtattaaattattaaattttttgttttgttattaatgtagtttatttttaatgtttttattgtatgtaagagagataatttttttttttttggtagaagaagggaaaaaaataaatttatattgagtagtgtgttgatgttgttatttggtttgggttaatttattgaagtatgttttgagagtttttttttggagtatgtaggaagatggatttgtagtgtagaaatttaggatttgtttaggatttattgatagaatatttatatagttaaatatgattttttttgtattgaatgtttgtaaaagtgtttattttttaggtgtggaggtaaatggtatagaaaagtttatttaattttattaaattttgttttttttttggtatgtaggttgttggttttttttttagttttgaattatgaattatgatagataagttagttaaaagtttgtaattgatttaaatgattatttattattttttaggtttgtttggttaatttagttggggtggggggtttttagaaagattttaagttttttttttaagtaaatgtttgtaaaaagttttttgaatgtgttttggattttattttgatggtgtttagataaattttgtttggattgtttgtgtttttggtattttagtttttaaatagtttgtatgggggaattttggttttttttttggtaaagaatagatttttttgtttttgaatagtttattttttattatttttgttatatagaatgaaagattgaattgtttaatatatgtgagtgaatttttggtgaattttatttgggttgttaatttttaaatgatttaattagtttgatattattaatttttaggatttttatagagtttaaaaatttttagtagttttgtaaaagtagatagttagagaggtaggtagtgagtgtataagttggtgtttttttttttattttttattttaaaaataatataagaagtgtttttaaaatgagtaggggaggagttgggatgttgtttttggtttatgttgagtattaatttttttttttttatgtttttttatttgtggtggtttagtttggaaaatggtgttttgtttgtgtttgtttgttttttgtttattgttttgttttttagtttatattttaaatttttttgtgtgtttttttgtttgttaaattttttataatttatgtatttttttattttagaaaaagtatatgtaagttttaaattgtagaatagagaatggttattttttgggaaaggtttgggttgggaaattttttattttatagttttttttttttttttttttttgtaagtttttggttgaattgattgtatttgtttgttttgtaatttagtttttgagatttatttattttgaaaaattttttttaggttttatgtagtatatagagtagttaggaattggttatttttgttttaaatatatagttatatagaaaatgagattttagatttggatttgaaaaaatagtatagtggttaagagtatgggttggggaattaaattgaattagattttaattttaggtttgttatttattagttgtgtgttttgggataagtatttaatttttttaggttttagtttttttatttgtaaaatgggtatataatattatttatgttagtgttaattgggaggatagaaataatatttgtatggtgttgggtaaatattatggaataaatgttagttgtgatttatttttatattgtttaattggtgaaataaaattttggggagatgagatttatttaaggttatatagtttagagttgtgattagaatttagttttttaggatgaaagtttaatgtgaaaattatttgtttgtttttatatttttgtattttaaatagttatgttggttgttttttttattatatatttatatatattttattatataattaaatgtatattttgtaaattggtttaagtatgatagttttatattttgaaggattagtttttttttattttagtttttgtttaatttttttattaaaatatagtaattttaagggaaaatgattttttagattttttatattgatttaatttataggaagaagagtttttttagttagttttaaaatattaagaaggatagatgtagtatttataaataaatttagttggatggagagttttaaaagggagagttaatttattttgtagttattttgtataatttgtttaaaggatgtaatatatattaaataaaggaaattttggagaggaattaaaatatttttttttttttattgtttttgtagtatttatttgtaatttttttataaaatagggtaggtaagtggttaggtagggagggagagtttttttgtttaatgtagggaagagtattgttttagttttttttttgtggatagtgttggaatgtgtattggtatttgggttttttaaaagtttgttagggggtattttattttatgttgaaatattgttttgtttagtggagttgttaagtggtatttgtggtgtaatatgaaaagtatgtattgtatatatttattaagttaaagatttttttatgaaggtatattaaaataatttttagtttagtaagtttagtttttgttattgaaaagtttagggtaataaaggggtgagatttttgttgaatttgtgtttgttatttttgtgtttttttttttttttttatatggttattattttgtaatagagatttattgtaagaaattttttaattataaagaaaatatatattttaagtaagagaatatagaggaatttataaaatatttaatatattgttattaaggtagttgtaaagatatataaagtattatattatgtgttaatttttatttggtttatgaggtttatggttttaaatgtttatttaaggtttttagagttttttggaaattgagtttatttttattggatagtggaggtggatgaaaagttgttagataagagaagaggaaatagttatattggaagtagagtaggagaaatttaagttagagatgagaaatatggtattattgataggtatgtgtgtatagggatttgttatttaggggaggttgttgtatatttttgtttaatatttttttaaagagtagagatgtattggttttagggaagtgaagatggggatgggtgtttttaaaattttgtttatttttattttttaagttatggaattagttttattgagtgagattattgtttttgaattttttatttttatattgtattattgtataaaaataataatattagtgtgtttttttttgtgtgtggtaaaggttgggtgatttgatgttttttttttttgtgtaagaaaatgtaaaatatataattattttgaagtttttaattgagaaatgaatttgggttttgaaatgaataattagtatttaaatttttatgaaaggaatagtatgggttttttataatatgataatatttgttagttaattaattattttttattatgaattaattatgttgatagtaataattagagttattatttaatttaagtattaatttataaaatagatttatgatttagttatatgttaattatttttttattagtaaatgtttatattttttgaaaatttgattttgtttttaaattttttattttaagtaaaatgaaggaaagatatataaataagttataattttttaaatatagatttgtgtattataaagattaatgagtagggtagaaagtgaaaaatagattgatttgtttgtaatgaaatgtaaattattgatatttattttaaatattagttatagggttggaagaaatttttttaaatatttttttgttatggtataaaataatattttgatatgtgttatttttattttttttgtgtttgattaatgatttaataaatgtatttttaattaataagtaaataaaaagtgaaaaataaaaagtaaaattttgagagtaaaatttattttgttttagagtaattgtatatttgttagtgtgatatagtatatttgaaatttataattataaaataaaaatttatagttagggtttagggtttatatttgtttttttggtttttgtatagtaattatttattggataatttagaaagaaatattatgaattatgttttgtaaatatgtttgaattggagagttttttgaagaaagagtagttgtgtttgtgtattgtattgtagttggttgtgtttaaaattgggttaatattttgtgatgtttaaataagaagatttttagaggtgtagatatatttttttttattataggggtagatatgtaaagtgtaggtagatataggtatagggttgggggaggtggatattgattgttttaaagatatgtttagtttttttatgttgttttggttttttgtttgttttttaattttttttttttgttaatttttttttgttatagttttgttagaagaataaatggttagtattgagtgatttgtgtgttttagtagggaagttaaggtagagatgttggtagtatgaggtaagtatgaggttttttttagggtttttatattagtaggtagagttgtttttgtgttggaagggagtgggggaagttttaatagtaataatatatggaaattttgtttgtggttttttagtatgaatatttgtttatataataggattgttgatgtttgtggattttatattaaaagatattaatgtattttttaaatgaatttgtaaggtggttttgggtatgagtatagtgattttttagaaattttagaaatatattttttttaaaaatgtttttttattttgagtgttggttattgtgttttttatttggtttttttttttttagttttttgtttttttagatttttttttataaagtttttttatttggttatatataaatattgtttttttaagataagggtatatttttttttttttatatttttgaattattttttttagtgtttttgtgttttttgttgttgatgatttataaagatagttttttaagtttaatagttttggttggttttaatttgaaagttaaatataatttttgttgaatgttttagtattgagtagtgagttgtgaattattttttagttgattgttattgttggtggtattgttttaatattagttttggggagatttatttttggttattttattttgtttatatttttttttttaaatttagatttttattttttttttttttttttaaaattttatttttatattttttattattttttataaatttagatttaagtaatatatgtttataaaaatttaaagttttgtttaaaagatataaagtgaaaagtaaaagttttttatatgtatttattaaatgttgaatatttattatgtgttaggtattttaattggtgtttggtatagatttgtatatttttttgggattgtgtgggggggtgttgtttgttgttattatattagtatggttttatgatatatattgttttgtaatatttttaaatttagtaatattttttgaatatttttttaaaataaa

SEQ ID NO: 599 - DNA, 2534 bp, Artificial Sequence
  chemically treated genomic DNA (Homo sapiens)
aggtaggaaagtgggatagttggggagttggattttattttttgtgagttttgttggtatttgatggtatgtggtttggagagggtaggtgatttggtgtggagggttagagggtaaatttttaaataagtggtaataggttattaatttgaaagggaaaattgtgtagtgatgggaaatgtgtttaataaatttattgggtgattaattataaaggttgggttggagttttagaggttgtttgttaaatattttattaagtggtattttgaaagttgttatttgtgtattttgggagtttagaggggattttgagggggaatgaggtttggaggatggaattatttttaggtagattgagaaggagtttggattttatttttaaatatagtttggagtttataggttagaggttttaatgggagaaaagttaaaggaagagggtgtagaaaggagttttagggaattggtggttatgtgattttgagtaaattttatttttttttgagatttagtgtttttatttttatggttttgtgtgtgttatagagatatggtggggattaaatttgattgtgatatgaaagtgtttgggaaattttatggttttatttaaatatgagttatttttatttgaattaaggggggaagttatttggtaggattaggaattttatttttttgaatttttatgggttttgttgaggttgaagtagttaggggttaaagttagtttttagtttttggaagggtattgtgaaagtggatttgatttgagaagttgttttttgatgtgggtagttatgtgatgttagttttgaataagagggggtagtttggagtttggaaaggtgttagtgtaggtggggtttatgtttagattttttttgttgattgttttgatgatttatttttatattttagtttttttatttttattgtagagttggaaagggtgtggggaagagaggagagggaggtaggttttgggttttggttttgttttttgtttttttttatttttttttgggtttggttatttagttaaaaggtaggttaagagtaggagagatatagagtttggtattggttttaggtagtagttagtttgttgtttgtttgtgtgtttttagagttatggagagagttagtttgatttagaaggttaagttggtagagtaggttgaatgttatgaggatatggtagtttttatgaaaggtgttgtggagaagggtgaggagtttttttgtgaagagtgaaatttgtttttagtagtttataagaatgtggtgggtggttagagggttgtttggagggtgttgtttagtattgagtagaaaagtaatgaggagggtttggaggagaaggggtttgaggtgtgtgagtattgggagaaggtggagattgagttttagggtgtgtgtgatattgtgttgggtttgttggatagttattttattaaggaggttggggatgttgagagttgggttttttatttgaagatgaagggtgattattattgttatttggttgaggtggttattggtgatgataagaagtgtattattgatttagtttggttagtttattaggaggttatggatattagtaagaaggagatgttgtttattaattttatttgtttgggtttggttttgaatttttttgttttttattatgagattgttaatagttttgaggaggttatttttttggttaagattatttttgatgaggttatggttgatttgtatatttttagtgaggatttttataaagatagtatttttattatgtagttgttgtgagataatttgatattgtggatggttgataatgttggggaagaggggggtgaggttttttaggagttttagagttgagtgttgtttgttattgttttgttttgttttttttagttttttattttgttgagaggattagtatggggtgggaggttttattttttttttttaggtgttgtttttgttttaaagggttttgtggagagggattggtagagttgaggttatttggggttggggattttattttttttgtagttgttgagtgtatttaattattggttatgtttttatttttgttttttgtatttgtttttttttgattttaggattaggttattttttttttttttttgttttttttttgtttttgttgtttttgattgtaggaattgaggagtgttttgttttgtggttgagaattggatagtggtaggggttggagatgggtgtgtgtgtgtgtgtgtgtgtgtgtgtgtgtgtgtgtgttagtgtaagattgagattgagggaaagtatgtttgttgggtgtgattatgtttttttttaataaagtttttttgtgatattttttttgttttttttttagtttttggtgatgggttgggagtgggattggaatttgatttagagattttgattttggatttttgagttagggttttgaattttttaggtggtttagtggtttgtatgtaagattttgagtttaggtgaggttggggttt

SEQ ID NO: 600 - DNA, 2534 bp, Artificial Sequence
  chemically treated genomic DNA (Homo sapiens)
ggattttggttttatttggatttaaagttttgtgtgtgggttattgagttatttagggagtttagggttttaatttagaggtttaaagttagggtttttaagttagattttagttttatttttagtttattgttaagaattggaagagagataggaggagtgttataggggaattttattgagaggaaatatggttatatttagtagatatgtttttttttagttttggttttgtattggtgtgtgtgtatatatatatatatatatatatatatatatttatttttagtttttgttattgtttagtttttagttataaggtgggatattttttaatttttatgattagaggtagtaggggtaggagggaggtaagaggaggggagaagtagtttggttttggggttgggaggaagtgggtgtggagagtaggggtgggggtatgattagtggttaggtgtgtttaatagttgtaagaagagtgggatttttagttttaggtggttttagttttgttagtttttttttatggagttttttggagtaagaatagtgtttaggggagaagggtggggttttttattttatattagtttttttggtagggtgggggattggagggggtagggtggggtggtggtgggtaatatttagttttggggtttttggggagttttgttttttttttttttggtgttgttggttgtttatagtgttaggttgttttgtagtagttgtatgatgagggtgttgtttttgtaggagtttttgttgagggtgtgtagattagttatggttttgttgaaagtggttttggttagagagatggtttttttggggttgttggtgattttgtagtggaagatggaaaagtttagggttaggtttaggtggatggggttggtgggtggtattttttttttgttgatgtttatggttttttggtaggttgattgggttgagttaatgatgtgttttttgttgttattggtggttattttggttaggtagtggtagtagttattttttatttttaggtagaagatttggtttttggtgtttttggtttttttgatgaggtggttgtttagtaggtttagtatggtgttgtatatgttttggagtttagtttttatttttttttggtatttatgtattttgggtttttttttttttgagttttttttgttgtttttttgtttaatattggatagtattttttaggtagttttttggttgtttattatgtttttataggttattgagagtaggttttgttttttgtaggagagttttttgtttttttttatggtgttttttatgaaggttgttatgtttttatagtgtttggtttgttttgttagtttggttttttggattagattggttttttttatggttttggggatatataggtgggtggtgggttaattgttgtttgggattaatgttggattttgtgttttttttgtttttggtttgttttttggttgggtggttaggtttagagaagggtggggaggagtagggggtgggattagggtttaagatttgtttttttttttttttttttttatattttttttggttttgtagtaaaggtaaaaaggttgggatgtgggggtgaattattagaatagttagtaggagaaatttgggtgtgggttttatttgtattggtatttttttaggttttaggttgtttttttttgtttggggttggtattatatggttgtttatattaggaaatggttttttaaattagatttatttttatagtgtttttttaggggttaaggattggttttagtttttggttgttttagttttgatagagtttataaaggtttaggaggatggggtttttaattttgttaggtaatttttttttttggtttaggtgaggataatttatgtttaggtagggttatggagttttttaagtatttttatattatgattgaatttaatttttattatgtttttgtgatatatataggattatagagatgggaatattaagttttagagaggggtgagatttgtttaaagttatatagttattaattttttgaaatttttttttgtattttttttttttagttttttttttattgaggtttttgatttatgagttttagattgtgtttggaagtgagatttaggtttttttttagtttatttgaagatggttttattttttaggttttatttttttttagggttttttttgagtttttagaatgtgtaggtggtagtttttagagtgttgtttaatgaagtgtttaataagtagtttttgaagttttagtttagtttttgtaattagttatttagtaggtttgttggatatattttttattattatataatttttttttttaagttggtggtttgttgttatttgtttgaggatttattttttggttttttatgttaggttatttgttttttttaagttatatgttattaggtattagtggggtttatagagggtggggtttagttttttggttgttttatttttttgttt

SEQ ID NO: 601 - DNA, 6558 bp, Artificial Sequence
  chemically treated genomic DNA (Homo sapiens)
taagattataaattgttttttattagtggggaaggttttaaatattatgtatttagtataagtaggtgtaattaattgtaatggtttgttttgttatttttgattaatatataattattaggttagaattgtattttataagttttttgtgtttagttattttgtatatattaatttttttaagttttgtgttttaaaagaattgtatagtgttgggaagttttttatttattttaatttttagggtattgagtttgaatttgaattaggtattaggtatgttttattattataaaagatgtaaaaagatgtgtatagtggtgtatatttatagttttagttattgaggaggttaatgtgggaggattatatgaggttgtagtgagttgtgatggtgttattgtattttagttttggtgatagtgagtttatgttttaaataagtaagtaaataaaaattaaaaagaatttagtttatagggtatttgaaggtaagaggaaaagatgttagaattagagatggggagaagatgggtttttggtgtttgttgaggttgagaaatgagatagataggttgagtgtggggtggagagaggatgggtagagagattgaggttggtttgaatggaaatgaaatgttagggtttttagggttattggggaataattggagtttttaggaaaggtttaatgttgtgattatttgtgtttgttatgtttttttattttttattaattgtgtgaatttggtagattttgagttttagtgtttttttttgtgaagtggggttattttattttaatttttgggattgttgtgtgaattaaatggggtaatgtatggagagtatttgatgtatagtgagtgttttaaaattttagtttgtattttttagtaaaggatatgtatatgtttattgtgagtgataaatttaggatgatttgaatttaatgtgataatgtgggtttttgtatgttggttatgttgttgggagatatttatggatttaattagtataataggggaaataaattatttaatgtattttgttaagatagaatattttagaatttattttgtggggtggggtataataaagggggtttttttgttgaaaatgtttaagtttaggtttgtggtattatttaattaaggttgatagttatatagtaagttagaggtaatgttaggatttaaattaaatttgtggtttttataatgaggttattttttttttttttgaatggtttggggaaagggggtgggtgggtagaatttggtagtggttaattttttatttttgttttttggtttttttttgtttttatttttaggtttgtattgattgattgattgagatagggttttgttttgttgtttaggttggagtgtagtggtatgattatggtttattgtagttttaaatttttaggtttaagtggtttttttgttttttattttttgagtatttatatttttaggtttttaaaatggtttttaggtatttggttgttgttttagatatttatttgggtttttgggtagggattgtttgggaaattttatttatgtgaagtaggtgtgggtgtaggaaggttgtttggaaatgaattagtattgttttttgtttgagttgtaagtagggtgttagagggtttggtggataagaaagggaggatgataggaggttggtattgtaatgatatgttttagttattagagggtatgaagtagttgggtaaaattttgtggggttgttggtggaaaatttttggtatttggagtttggagatggggtggatggaatgtgaggatttagttttttgaggttgggttggggtagagttattgttttggatgtttgtagggtttgtttgtgttttgattattttgtttttgtagatagttggagaatgtgagagtgggattgggattggattttaggggttattttgtataatttttttgttttgttgtgggggagggagttgtttaaggttatgtagtaagttagtggtaaatgaatatgattattattagttttaggtatatggttatttgatgggtgtagttgtagttttagtttttgagatagagatatttgattaaggataggtttttaggagttgattttagtgatttgtggttttgttgttgtttttgtttttttttttggtttttttatttgattgattttttgttttttttgtttgtttgtttgtttttgtttttgtttgttggggggtttgtttaatttttttattgggttttgggagttgtagttttttgttgttattttttagggatttgtagttttttgaagtttttttttgatttgttgttttggttttatttttgggatttagaggagaggtgattattttgtagtatagttagtggtgtgattttatggggtgagaaggatttttttgtttttaagtatttttttagtgatttttgttgttatgtggtagttgtaagtattggttggtatttggtgtgggtgagatttttattttatgtagaaatgagtaagattggtgagtttattatgtgggggtgaggttgagagaaaataagtatataggtgatttagttaaaattagaattttttaagtatatatgaaaagggtaaaaggggtgttttgtataggatagaataggtagatattgaatttggttgggttttgggaaggttttttgtagtggtttttgaagggggggttggattttagtaggatagagggtatgggtatgtgtgggtatgttttgaatagaggggttagtgtaagttgagggttttggttatattagttgtatgtgttggtgtgtttaagggatatgtagtagtaggttgagtttggagtgttttattgttaggttttttaaaaatttttaattttaatttaattttattttatttttattttaagttttggtatatatgtgtagaatgtggtttgttatataggtatatatgtgttatggtggtttgttgtatttattaatttattatttaggttttaagttttgtatgtattaggtattagttttaatgttttttttttttttgtttttatttttttttttgtaattgtttataggttttggtatgtggtgtttttttttttgtgtttatatgtttttattgtttaatttttatttatgagtgagaatatattgtttggttttaagggatagttatggggatgtattgtagtttttgagtagggaaggttttgtggaggtttttagttaaaaggaaagaatggttgtgaaaattgatgtattgtgtttttttgttttttatttttagtgtgaagggtttttattttgagttttatttgaagtaggttttgatgggaagataagtagtatgaggggtttaagtattgaggggagtaagggatatttggtggttgtgttaaggtgtagaagaggatattgggggttttaaggtttgattttatgtatattgtttaggttggtttttaagttatatggtgattgttaggaagggattagtttgtttttagtttgatttttttgttatgttattatttaaagttttttttggtagggtttgtttggggtttttgtgttagtgttttttttgttaggttgggttggggtttttatttattgttttgggattgttgttgttttggttttgggggaggagggtgtgttgttgagttattgtttgggtatttgggtttggaattttgggtgagttatttagggttgaggtagaggggttgggggaggggaagaagttatttgatagttggagtagggaggggagttggggttataggaagggtggtgttttgatgtttagatgggttgggatagataaagggttaaggaggaaggggttttgggagggggtagtttttttttgggttgggttttgaatggttatagtgtttgtttttttttgggtttggggaggatatgtgtgtggggggtagtgagagagggttgtggttgagggttgtgttttaggtttggattttggtttgggaagttgtttagttggtgtttttagttttgggtagggatgtatttttatttatttatttagtttttaagttggagaagaggaggttaaagtttttttgtttagtttttaattatttgggatttttttatgttttttatagattgtggtttagtttaattgtggttgtgtgtagagtaattttattttttattgtttttttatttttttagatatttttttatatagagggatttttttaggtatttttaagtatatttagttattttattattttattaagaggtattttggtgttggttattaaaagttattttattttatttatgttttgaagttagttttgtttttttttttttgatgttttttagttgttttttttggtttttagttttttaagggtggttttaggttgttttttttttatatatataggtgtatgtatgtatatgagtattggattatgaagttttagtgtgtgtttatagttttttatataggagtgggttgtgatttataggtatgttatgagaatgaggtttggtattagtttttaggttttagagtaggggttgtttttttttattttggtttaggatgtttagtttttatgatattttttattttttattgtggtttgggtgggtttaggggttgtttttgatttggtttagagtttttttttagttggtggtggagttggtattttttgggagggagggggttgggagggaatgagtgggaatggtaagaggttagggtttggtgggattaggttgaggtaggtttggtttttttaaaatgttaagttgggggttagtggggtttatatataaatttttattttgggagtttggttgttttgtttttttttttgggtttgtttttgttatttggtttggtgagtatttttgttttgttgagggtagggtggggaggatttttgtgggtttttgtttttgtttttatagtttttttattttagtttttttggtgggattaatttgggtttttttgggtttttttttttggaagaattttttgtgaagtgttgaagtgttgattgaagggttttttttttttttttttttttttgagatggagttttgttttgttgtttaggttggagtatagtggtgtgattttagtttattgtaaatttttttttttaggtttatgttatttttttgttttagttttttgagtagttgggattgtaggtgtttattattatgtttggttaatttttttgtatttttagtagagatggggttttattatgttagttaggatggttttgattttttgattttgtgatttatttattttggttttttaaagtgttgggattataggagtaagttattgtgtttggttgattgaagggtttttttttaggtttttttgtgaggttttagtgtaggggttgttttgaggtttttttttggatattttagtttaggggtttttttttgggggtttaggtttaggagtaggaggtgtgtatgtgggtgttgttgtaaaaagaattttgagatttttttttttttttttttttttttttgtaaagttttggattttagtaggattaaggtgtaagaggtaggggttttaagattttgtttgggttatggttttaagtagtaaagttttgttttttgttttggtgaaggtagggttggtatgatgggtttagggtatgttttgtttttggtatagtttttttggttttattttgaaatttgtttaatttttttaggttggtttgagtatttttagaggttttgttgttgaggtttgttttattttgattttaaggtaatgaatattttatatttttaattttaattttaataggattttttttggtggagagaatgttaagttgtttttattttatttatgtttttgtttgtttagaggtttaggggtttttagggtgaggggagatatattttttattttttgggagtttttagtttgagagaggaaatatttttgtttaagggagtttttagttagatggtagagagagatgtttttggttttaggagttttgagtttaaggagggaaatgatttttttagggagttttttgtttttaggttgtagttatggtttttgttagattgtataggagtttttatttgttagttggtgtatgtggttttgttttttagagtttgtgtagatgttattaaaatgggattttggttattttgttattttttttttggtagatattaaaatggggagttttgtttttaggggggtgttttaagtgttattagaggaggtttggtgatttttagatataagggaagttttagtgtttgtttttagggtgagatggaggtattgtttttggttttagggaattatagtttgagggggagatgtagtttttgtttttttatttagagaggggttttgtgaggtggtttgggggtatagggtagaagtggattttataggttgagttaaggttttaagagttttagtagtgtatttattatttggtatttttgtagt

SEQ ID NO: 602 - DNA, 6558 bp, Artificial Sequence
  chemically treated genomic DNA (Homo sapiens)
gttgtagaggtgttaggtgatgggtatattgttgaggtttttggggttttagtttagtttgtaggatttatttttgttttatgtttttaagttattttataaaatttttttttgaatgggaaggtaggggttgtattttttttttagattgtggttttttgaggttggaggtgatatttttattttattttgagggtagatgttaaagttttttttgtgtttgggagttattaagttttttttgatggtatttgggatatttttttgagggtagggttttttattttagtgtttgttagaagggaaatgatagggtgattagagttttattttgatggtatttgtgtaggttttggggagtagggttatatgtattggttggtagatgggggtttttgtgtagtttggtaggagttatggttatagtttaggagtaggaagttttttgaaggagttgtttttttttttagatttgggatttttgaagttagaggtatttttttttgttatttaattggaagtttttttgggtaggagtgtttttttttttagattaggagtttttagagggtggggaatgtgtttttttttattttgaaggtttttgagtttttaggtagataggggtatggatagggtgggggtaatttaatattttttttattaggaaggattttgttggaattagaattaaagatatgaaatgtttattgttttgggattaggatgggatagattttagtggtaaggtttttgagaatatttagattagtttggaaaggttaggtaggttttagggtgaggttagaggagttatgttagaggtagggtatgttttgggtttattatgttagttttgtttttattgaggtagggggtagagttttgttgtttggggttatgatttaggtagagttttgagatttttgttttttgtattttagttttgttagaatttaggattttgtaaaaaaaaaaaaaaaaaaaaaaaaaaattttaggattttttttgtagtaatgtttatatgtatattttttgtttttaggtttagatttttaaagaagggtttttagattgagatatttaggggagggttttagagtaatttttgtattgagattttatagaggaatttggagaaaaattttttagttggttgggtgtggtggtttatttttgtaattttagtattttgggaggttgagatgggtggattatgagattaggagattgagattattttggttaatatggtgaaattttatttttattaaaaatataaaaaaattagttgggtatggtggtgggtgtttgtagttttagttatttgggaggttgaggtaggagaatggtgtgaatttgggagggggagtttgtagtgagttgagattatattattgtattttagtttgggtgatagagtgagattttattttaaaaaaaaaaaaaaaaaaaaaaaattttttagttaatattttagtattttatagagagtttttttaagggggaaggtttagagaggtttaggttgattttattagggaagttggaatgagagaattgtggagataaagatagagatttatggggattttttttattttgtttttagtaggatagaggtatttattagattaggtggtagagatagatttaggaaggagagtaaggtagttaggtttttagggtgaggatttatatgtgggttttattggtttttaatttggtattttaaggaaattaaatttgttttaatttgattttattaaattttggttttttgttatttttatttatttttttttagtttttttttttttagagagtgttagttttattattagttgggggagggttttaggttaggttaagggtagtttttgagtttatttaggttatagtgggaagtgggaggtgttgtggggattgggtattttggattggggtgaggggaggtaatttttgttttggggtttggagattggtgttaggttttatttttatgatatgtttgtgagttatagtttatttttgtgtgagaggttgtgagtatatgttgagattttatggtttagtgtttgtgtatatatatgtgtttgtgtgtgtgagagagaagtaatttggggttatttttaggaagttgggggttagaggaggtagttgggggatattaggaggagaaggataggattgattttagggtatggatgaagtggagtgatttttaatggttagtattagaatattttttaatgaggtaatgaggtaattaagtgtgtttagaaatatttgggaaggtttttttgtgtaggaaggtgtttggaaggatggggaagtagtgagaaatggggttgttttatatatagttgtagttgggttgggttatagtttgtggggagtataaggaagttttgagtagttaaaggttgaataggaaaattttggtttttttttttttagtttgagggttgggtgggtgggtaggggtatatttttatttaaggttgaaaatattagttggatagttttttaagttagaatttaggtttgaagtatagtttttagttatagtttttttttattgttttttatatatatgttttttttagatttggagaaaggtaaatattgtggttatttagagtttagtttaagggagggttgtttttttttagggtttttttttttttggttttttgtttattttggtttgtttgggtattagggtattgttttttttgtggttttagtttttttttttgttttagttgttgagtagttttttttttttttttagtttttttattttagttttaagtgatttatttgaggttttaggtttagatgtttaggtagtgatttagtggtatattttttttttttagggttagggtagtagtagttttagagtagtaggtggaagttttagtttagtttggtagggaaagtattggtatagagattttaaataggttttgttaggaggagttttggataatgatatggtaggaggattagattgagaataggttggtttttttttagtggttattgtgtgatttgggggttagtttgagtagtgtatatgaagttaggttttggggtttttagtgtttttttttatattttggtatagttattgagtgttttttgttttttttagtatttgaattttttatgttatttgtttttttattgaggtttattttaagtagaatttggaataaaaattttttatattgagggtgagggataagggagtgtaatgtattgatttttatagttattttttttttttaattaagggtttttatagggttttttttgtttagaaattgtagtgtatttttatggttgttttttaaagttaggtggtatgtttttatttataagtgggagttgaataatgagaatatatggatatagggaagggaatattatatattagggtttgtgggtagttgtggggagaaggatgggggtaaggggagggagagtattaggattaatatttgatgtatgtggggtttaaaatttagatgatgggttgataggtgtagtaaattattatggtatatgtatatttatgtaataaattatattttgtatatgtatgttagaatttaaagtaaaaataaaataaaattaaattaaaattaaaaatttttaaaaagtttggtagtgaggtgttttagatttggtttgttgttgtgtgttttttaaatatattggtatatgtaattagtgtggttaagatttttggtttgtgttgatttttttgtttagaatgtgtttatatatgtttatgttttttattttgttgaaatttaattttttttttaaaggttattgtagggagtttttttagggtttaattggatttagtgtttatttgttttgttttgtataaagtgttttttttgttttttttgtgtgtatttagagaattttgattttgattgaattatttgtgtatttgtttttttttagttttatttttatatggtgagtttattggttttatttatttttgtatgaggtaagggttttgtttatattaggtgttaattagtgtttatggttattatatggtaataggggttattggaggagtgtttaggagtaagggagttttttttattttgtgaaattatattattgattatgttatgaaataattattttttttttggattttaagagtggaattgagataatgggttggaaaagagttttagagagttataaatttttgaggagtgatagtaggaaattgtggtttttaggatttagtgagggagttgagtaaattttttagtgggtagagatggagataggtaggtagatgaagaagataaagagttagttagatggaaaagttagggagaaaaatagagatagtagtagagttgtgggttattagggttagtttttgaaggtttgtttttaattaggtgtttttgttttaggaattgaggttgtgattgtgtttattaaatggttatatatttgagattggtgataattgtatttatttgttattaatttgttgtgtaattttgggtaatttttttttttatggtagggtaggagagttgtatggaatggtttttagagtttgattttaattttatttttatattttttagttgtttataaaggtagagtagttaagatataagtaggttttgtggatatttaaagtagtgattttgttttggtttagttttaggaagttgggtttttatattttgtttattttatttttgggttttaggtgttagaaattttttattagtggttttgtgggattttgtttagttgttttgtgttttttggtggttaaggtgtgttattgtagtgttggttttttgttatttttttttttttgtttgttagattttttggtgttttgtttatgatttaaataggagatagtgttgatttatttttaagtggtttttttatatttatatttgttttatatagatgaggttttttggatagtttttgtttagaagtttaggtggatgtttgagatggtagttagatatttggaagttattttaaaagtttagggatatgggtatttgggagataggaggtggaaagattatttgagtttaggagtttgaggttgtagtgagttatgattgtgttattgtattttagtttggatgatagagtaagattttgttttaattaattaattaatgtaagtttagagataagggtaggagaaaattaggggatagaagtgagggattggttattgttaagttttgtttatttattttttttttttaggttgtttaggggaaagagaaatggttttattgtgggggttataggtttagtttaagttttgatattgtttttggtttattgtgtgattgttgattttggttgagtggtgttatgaatttgagtttaaatgtttttagtagaaggattttttttattatgttttgttttataaaataagttttgaggtattttgttttagtaaaatgtattaaataatttattttttttgttgtattaattggatttataagtgttttttggtagtatgattagtatgtgaggatttatgttattatattgggtttaggttattttggatttgttatttataatgggtgtgtgtatattttttgttggggggtgtagattgaaattttgaagtatttgttgtgtgttaggtgttttttgtatattattttatttaatttatataataattttaggagttggaataagatgattttattttatagaggagaatattgagatttaaagtttgttaaatttatataattagtaaggggtggggaggtatgatgaatataggtggttataatgttaaattttttttagaagttttaattattttttgataattttgagagttttaatattttatttttatttagattagttttagtttttttgtttattttttttttattttatatttagtttatttgttttattttttaattttagtaggtgttagaagtttattttttttttatttttgattttggtattttttttttttgtttttaaatgttttgtggattggattttttttaatttttgtttatttatttatttgagatatagatttattgttgttaaggttggagtatagtggtattattatagtttattgtagttttatgtgatttttttatattaatttttttagtaattggggttataggtgtgtgttattgtgtgtatttttttgtattttttgtggtgatggagtatgtttgatatttgatttgaatttgagtttggtattttaaggattggaatgggtaaagaattttttagtattgtatagtttttttaaagtataaagtttgggagaattaatatatgtaggataattgaatgtaagagatttgtggaatgtagttttaatttgataattgtgtgttaattgggagtaataggataggttgttatggttggttatatttatttatgttagatgtataatgtttggagttttttttattgatgagaagtaatttatgattttg

SEQ ID NO: 603 - DNA, 1334 bp, Artificial Sequence
  chemically treated genomic DNA (Homo sapiens)
aagtgatttttttgatttaatttttagagtagttaggattataggtatttgtattatgtttggttaatttttgtattttttttttttgtagagatggggttttggttatgttggttaggttagttttaaatttttgattttaagtgatttgtttgttttggtttttaaagtgttgggattatagtgtgagttattgtgttaggtttataattttattattaaaattaattttattgtaaaagaattagtttaggtttagatggaatgggttttatgagtttttttttttttttttgtaaggttatggtggttattttgtgagttattgttgttaggttaagtttttttttggttattttttattatgaattatttttgtagtgagtatagtatttattttggtgggagggttttttagatatgagtaggatttggattaaggttaggttggaggagatttttatgggaaagagggattttttgaattttagattttttagttaagatgattttattatatgttgtttttgtttattagtaaatttttttatgtagtttgattatgtttaggaaatatttttgataaaaattagtggagattattgttttagaggatttttgggtttttttaggtaaatgttatttaatgttttttaagtaaatagagtttgttttataaaatttggggtttgggtggttttttatttttgatttggggttgtttttggagtagagaggaggtaatggttattatggagaataaggtgatttgtgttttggttttggtgtttatgttggtttttggtattttggttgaggtttagataggtaaggtatgtttttttttgttttgtggggttatagttagttttggtagtttttgttaggagttattgttttatatatatatttttgagtatttgttttgtgttaggtgttgttttaggtttttaaaagtatatttaatttataggattggtaaaagtaggtggagagtaatttagggtggtagggtttttggagatttttgagaaatgtgatgaggagggggttgtttttagttggggttgtttttttgtgttaggaagattatataatttttttaagtgttatgttttaaagaggaagtgttggtgtggggttttagaatagtgtttttgattgtttatgttaatgttttttttaggggtagatttttttagggtttatttagataggtttaaatgttggttttagtgatggttatttaggagatttttttttataggtttgaatgtttattttagtggtggttaattgggagatttttttttataggtttttgggtttttttt

SEQ ID NO: 604 - DNA, 1334 bp, Artificial Sequence
  chemically treated genomic DNA (Homo sapiens)
gaggggagtttaggaatttgtaggagagggttttttagttggttattattgggatgggtatttgggtttgtgggagagggttttttaggtggttattattgggattggtatttgggtttatttggatgggttttgggagggtttgtttttggggaggatgttggtatgaatagttaaaagtattattttgagattttatgttaatattttttttttgaaatatgatatttgggaggattgtatagtttttttaatataggaaaatagttttgattgaaggtagttttttttttgttgtattttttgaaggtttttgggggttttgttattttgagttattttttatttgtttttgttgattttgtaaattggatatatttttaagggtttagaatagtatttggtataaaataggtgtttaaaaatatgtatgtaaaatagtggtttttggtggaggttgttagagttggttgtggttttatagagtaggaagaagtatgttttatttgtttgggttttggttagggtgttgagggttagtatggatattaggattagggtgtagattattttgttttttatggtggttattgttttttttttgttttaaaggtgattttgagttagggatgagaggttgtttgagttttggattttatagggtaggttttgtttgtttaaagagtgttagataatatttgtttaaggaggtttggggattttttgagataataatttttattgatttttattaaaggtgttttttagatatggttaagttatatggaaggatttgttgatagatagagatgatatgtggtgaggttattttggttgagggatttgagatttagaaagttttttttttttatgggagttttttttaatttgattttaatttaggttttatttatatttgagaggtttttttgttagggtaaatattgtatttattgtagaagtgatttatagtgagagatggttggaaaaaggtttggtttgataatagtggtttatggggtggttattgtgattttgtagggggaagggaaggagtttatgaagtttattttgtttaggtttaagttaatttttttatagtggaattggttttaataatgaaattgtaggtttggtgtagtggtttatgttgtaattttaatattttggaggttaaagtaggtggattatttaaagttaggagtttgagattagtttggttaatatggttgaaattttgtttttataaaaaaaaaaaatataaaaattagttaggtatggtgtgggtgtttgtaattttagttattttggaggttaagttaggagaattattt

SEQ ID NO: 605 - DNA, 6432 bp, Artificial Sequence
  chemically treated genomic DNA (Homo sapiens)
tattatgtttagttaatttttgtatttttagtagagatagggttttataatgttggttaggttggttttgaaattttgattttatgatttgtttgttttggttttttaaagtgttggaattataggtataagttagtatgtttggtttatattttttaattgtatgtataatttaatttgtagatgattttaaaagtttaaattggagttttattgttttttttatttttagtttttataataaattttatgatagtttttgtttataagaatttttttgtagttttattatttgtaaattatttaattttgtttttttgtgattttttattttttatattttttatattttttagttattgttttaaaaattttggataataaattaatttaaatttttttttaaatggtatttatttatttttatttagatttatatggattggttagaggtaggtttgagattggttgatggaggtttggtttagatttaattaggaggttggtttatatttgttttatatgtttttttttttttttgtatttgttggtttttaagtgtttttaattgaaaataattagtatattaaagtagtatattttggagtggtattttttgaaattttttattggttaggtggtgaagattaattatttgattaatttgttttagagtgtagaataagtttggaattagataggattaagtttaaatttgggttttgttttttattagttatgtgatttttgttaaatatttaatttttttaatttttaaattttttatttgtaaagggaagattagaatagtattgtaaggatatgttttaaaatttaataaggattatttttggataatagggttaagaatttttttaaagtttgtttttaaaaaaaaaatttaaattttttatttataattaatatgtattatttttgtaatttttaaaaagttattttttttaaaatatattattgatgttttttgtaaatatgtggtataattgtaggttttattaatatttgtgaagaattgtaaataagagaatggattaggaaaattgatatttttatttttttttttattgaagataagaaatatatattgaatattgattatttgtagagtatggagtgtggttttatattgaaaaaggaatattttgtgtttttaagggttttataattattagggtagaattttaaaaagtaaataaataataataatgtattttatgttagaatggggtaaatatttttttttaaaaaaaggttaaataaatgaaatgttttttgggttatttttgggaaaggagtgattatagtaggtgaagtattataaaatattttttggaggaggtagtattatggatgatttataaagggtggatgatttttataaattaattatagttttagtgtttattggtttgttttataataaaaggaaaattggttaagagataagagttgagaatgaggttggttaatttataaggagaggaatttttttgttaattgttttagttgatagtaattttaatagttgtatgttataaagtttaggggagtaggaagttttttttttattataattgagaaatttaatgtttaaataaattataatttgatttagtttaattgtgtgtgtttgtgtgtgtgtgtagagtttaaaaagttggtaaaatagattgttagtttttaaaatttttgtttaagttgatatttattgttttttaatttattaagggtttaaatgttattttttttgttttttaaattttgagttgggttattatttttttgtttttatttgtaaatggtttagttttttatatgtatatattaattgtttatgtgaatatataaaatattatattaagttaaatatataattatgtgtgaaaatgatgttttgattaagggtattagatattttttttaataagaattttaaaaggaagggtattatgataattttttttttttttttttttatttattttttgtttttgagatagggttttattttgttttttaggttgaagtgtagtggtataattatggtttattgtagtgtttgttttttgggtttaagtgatttttttattttagttttttgagtagttggtattatagatatatgttaatatgtttggtttttttttttttttttttttttttagtaaagatgaaattttattatgttgtttaggttggttttgaatttttgggtttaagtaatttttttatttagattttttaaagtgttgggattataggtgtggattattgtatttagtttgatgaatttttaaaattattaaattgtaatatgtatgagtttatatatttattatttttattatgatgatttttaaaaggttagtttgtatttggtaatgttgaattttgattttttttaattttataggagattggagattaaattagaaatgttaagggtaaataaaattaaaattaatattaatgatgtattatggtaaagattattagttaaatattttattatagatttaaatatttagtttttaataatgtaaaatatttttgtgataattaaggaaaataaagtttttggaatttattggatatttatttgttatattgtgtttttaggagaaagaaagtatatgtttgttatttggaggaatttgggtaaatgtaggaaaaaaaaaagaagaagaaagaaatttatatatttttttatttttaagaaaaggaagtagtggtgatattatttttggttaaaatgtagtttgtttatattttaaatatttggtaataatgttttttttagagttatgaagtaattagaataattaaatataatttttttttaaatttttattgtttgatttatttatttatttaataaatatttattaaatattgattatgtgtttgatgtttagggatataatagtaagtggagggaaagatatataatatttgtttttaagaaatttggagttgagtggaggatagaaatataaattaaagaatgatataaataattataaagttatagttgttaaaagaaaagtatatggtgttaagagaatgtgtaatataagatttatttatggaggtgagggaaagtttgtttattaaagaagttatgatttaatttatgaagattaggagttggttgggtgaagaaaaaaaggttagaggaaggaagtttatattggggaaggttttaagtataaagggtaggaggattatagaggtatatttatgaaatttggagaaggtttttagtaagtaaggagaagttaaatgaaagtttatgggagagttggaggtttgaagatatgtttaaggatttggtttttattttttttttattttaagagtagtgggaagttattaaatgattttaattagagggttggtataattagttttgtattttgaaaagttgaatttagtttttgtttgagaaattgagtgaaagagtttagaatggttgtggttgagggtgatttgtgggagatttttatataagttatggtagtggtatgggttggtggtagaagagggaatagggagaagatttggaatttaatttttttttattgataaagttattttagttttggtaaggtaattaattggtgggaaagaagatgtttagtttttttgattttattgtattttttgtatttttaatatgagtattgggaagtggtaaaatatttagaggtagtttgggtgttaggtggagtatgagttaaaattttaggatgaagtaaatgaatatttagaatgataggaaagatttgggagttgggtttgggggagggttatttatttttattttttggagattttggtataaatttttgtttttgtaattttttttttaggtaaaggaatttattaaatgaattgttagaagatttattgattagagggttgtatagaattatatttttgagagtgggaagtaggttgattatatagtttattatttaattaggatatatttgaaagagaaagggggttttattaatatttaaattataaaatatgtatattaggaatgttttgggtaaatttggttgttttagtaagaaaggaaatttgaaagtttatattgttttgtttttatgttattttgtttgtatatgagagggtaagtattttttttttttatttgtattaagggaataaaagtataagtatttaggtgatttttaatttatttttaattttatagtttttgttatattttatatattttgaaaattatattttttattattattattttgtgataggtgattatttataattatttattgatttagttttgggaagaggtggtgtaaaatgggatgttttatttaggtgtttattagaaatgtagaatttttgtttgttttttagatttattgaattagaatttgtatttttaaataagatttttaggtgattaatatgtatattaaaatttgagaaaaatttttagattttgatttaaagaaaaatattttataatttgatagtgtatgtatatatatatatgtatatagatataattgaagtataaatttaatgaagtagaatttattgttattattttatttgggaaagaaatgtgtttgtgatttaatagattggagtatttatttttggattttaatttgtaatttgaaaatgtatttttaaagtatttaggagtaatttgaagaaagttgaggggaggtggtagatgttttgatttattagggaaaatgtggatgttttttgttgttattttgtgaattgtgtgtatttagttatttttgagtaaatatttggagtgaggaatttttgagtggtgtgggagggtggtgaggggtagttgaaagttggttaaagtttttggaggggttggtttaggaaatatgattggtagttatgagagagttaggggttggatgttgaggagagggagaaggtttttgggtggagagaggttttgtttagttgttggtgaggagttttttgttttttttgtagtgttgagttgaagttgagtgagttatttgtgtgtatggagtgatgatatttttgtgtgtgtatttgtttgggataggagttggatttttgtgtagttttttttggttgttgggggtttttttgtgttttgttggtttttaggtttttttttggttggtgagtgggtgttatatttggtttgtatatttgtgttgttggtttggtgtggggtttggagagggtgtggtgtggaggtgtagttaggggtttgggaaggtgttgtttgttgtgttgggggtttggtttatgatgagtagtggggtttgttatgggttgggggttgtttaggggtttgtggttgttgtatattgttttgtggatgtgtattgttagtatgattttattgtatgtttagaagttgggtgagtggtttttagtttgggtttggtggggtgttgggggtttttttggggtttttgtttttttgttgtgtttgatagttgggtttggtaatttggtttttgggtggaaatgaggaaagttttttttgtgatatttatgtagtttgatttttgtagttgtagggattgtgagttttttttgaaaaagagaaggaaagtttagttgtaaggggtgtggggtatgtttggttttttttgtgtgagtaggaaaggtgttgtgttggttgtgtttgaggtgagtttttatttttggaaagggaagtttgagaagttggttatttgaaggtggttggggagtagtggtttggagtggtagtttgagttgttaaagtagttagtgtatttgggttattttgtttatggtgatgttgtgtgtttatttagttttttttgagttatttgtttaaaaggttagttttttagtttttagtttttggagatggttatgtttttttttaggttggttttttggtttggagtttttggaaataagttttaagaaaataattgatttttaaaagaaagttagttggttttattgatgttttggtatggatggatagggagtggagatgtttaggtgaaattgagaattttttattgaatgtttattgggtgttagaggttgtagattttgtttggaataagatagttttgtttttagggagttgatggttttatgtaattattgtttgttggaaattgaagggttaaaattttaattaggttatttatttgattgttgtttttgaaggtttttaaggaaaaaataaaaataaaaaaatatatatatatattatatatatataaatatatatataattatatatataaatatatataatattaatatatatatgtatgtaggaatgggggtttttaattatttgttatggaaagtgtaaaatttttgagattttaaaagttagattttttttttttggagatggagttttgtttt

SEQ ID NO: 606 - DNA, 6432 bp, Artificial Sequence
  chemically treated genomic DNA (Homo sapiens)
agagtgagattttgtttttaaaaaaaaaaaatttaatttttgaagttttagaggttttatattttttataataaatagttaagaatttttatttttgtatgtatatatatattaatattatatatatttatatatataattatatatatatttatatatatataatatatatatatatttttttatttttattttttttttaaaaatttttagagatagtgattaggtgggtagtttagttaggattttaattttttggtttttaataaatgataattgtatagaattattaattttttgaagataggattattttgttttaggtaaaatttatagtttttagtatttagtaggtatttagtgagggatttttggttttatttgagtatttttattttttatttatttatgttaaggtgttagtggagttagttaatttttttttggaaattgattatttttttgaaatttgtttttaaaaattttgggttaagaagttggtttgagggaaagtgtggttgtttttaggagttaaggattgaggagttggttttttgaatgggtggtttaaaaagagttgggtgggtatgtggtattgttatgggtggagtggtttaggtgtgttggttgttttggtagtttaggttgttgttttgggttgttgttttttggttgtttttagataattaattttttaaatttttttttttgggggtgggggtttgttttgaatgtggttaatataatgttttttttgtttgtataaaggggattaaatgtgttttgtgttttttgtaattgaatttttttttttttttttaagaaaaatttataatttttgtagttatgggagttgggttgtgtgagtgttgtgggggaaattttttttgtttttgtttgggggttgggttgttgggtttgattgttaagtgtagtggagaggtggggattttaggaagatttttggtgttttgttgagtttgggttggggattatttatttgatttttgaatgtgtggtgggattgtgttggtgatatgtgtttataggatgatgtgtagtggttataggtttttgagtagtttttgatttatggtagattttgttgtttgttatagattgagtttttagtgtagtggatggtgtttttttggatttttggttgtgtttttgtgttgtgttttttttggattttgtgttgggttggtagtgtagatgtgtgggttagatgtggtgtttgtttgttagttaggagggggtttggaggttggtgaggtgtggggaggtttttggtggttgagggaagttgtataggagtttggtttttgttttgagtgggtgtatgtgtgggggtgttgttgttttgtgtgtgtgagtgatttatttaattttaatttagtgttgtgggggaaataggaaattttttgttaatagttgggtaggatttttttttgtttgagagttttttttttttttttgatgtttagtttttagtttttttgtagttgttaattatgttttttagattagtttttttgagagttttggttgatttttagttgttttttattgtttttttatattatttaggagttttttgttttaagtatttatttaagaatgattaagtgtatatagtttataaagtaataatagaaaatgtttatgttttttttagtagattagaatatttgttgtttttttttagttttttttagattgtttttaggtgttttagagatgtgtttttaaattgtaagttgagatttaggagtgaatattttaatttattgagttgtgagtatattttttttttaaataaaatagtaatggtaaattttattttattaaatttgtgttttagttgtgtttatatgtatgtatgtatgtgtatatattgttaagttgtaaaatgtttttttttaggttgaagtttagaggttttttttaagttttaatgtatatattgattatttggaaattttatttaaaaatgtagattttaatttagtaggtttaggaggtaggtagagattttgtatttttaatgagtatttggatagagtgttttattttgtattgtttttttttgggattgagttagtgagtaattgtaaatgattatttattatgaagtgatagtggtgggaaatgtaatttttagaatgtatagagtatagtagaaattgtaaaattaaaagtgggttgggagttatttgaatgtttgtgtttttatttttttaatgtaggtgaagaaagagaatatttatttttttatgtgtaaatggggtaatatgggagtagaatagtataaatttttaaatttttttttttgttagggtaattagatttgtttaagatatttttggtgtatatgttttgtagtttaaatattaatagaatttttttttttttttagatatgttttgattggataataaattatgtgattaatttattttttatttttaaagatatgattttgtatagttttttggttagtagattttttagtaatttatttaatgaatttttttatttgagaggaagattgtagaggtaagggtttgtgttagggtttttagggaataaaggtaaatagtttttttttaaatttaatttttaaattttttttgttattttaagtgtttatttgttttattttggaattttaatttatgttttatttagtatttaagttgtttttggatgttttgttattttttagtatttatgttgaagatgtagaaagtgtagtgaaattaggagggttaggtatttttttttttattaattaattgttttgttaaagttggagtgattttgttaatggaggaagattgagttttaaattttttttttatttttttttttgttattagtttatgttattgttatggtttgtgtaggagttttttatgagttatttttagttatggttgttttgggtttttttatttagttttttaaatgagagttgaatttagttttttaaaatataaaattagttatattaattttttgattaaaattatttaatggttttttattgtttttgagataaagagaagataaaaattagatttttgaatgtgtttttaagtttttaatttttttgtaaatttttatttggtttttttttgtttattgaaagttttttttaaattttgtgaatatgtttttgtaatttttttattttttatgtttagagttttttttagtgtggattttttttttttgatttttttttttttatttagttaatttttggtttttgtggattgaattataatttttttgatgggtaagtttttttttatttttatgagtagattttgtattatatgtttttttggtattatatgttttttttttaatagttgtaattttataattatttgtgttattttttaatttatatttttattttttatttaattttaaattttttgagggtaggtattatgtatttttttttttatttattattgtgtttttaagtattaaatatataattgatgtttaataaatatttgttggatgaatgaatgaattaggtaataaagatttagaagaaaattgtatttgattgttttagttgttttataattttggagaaaatattgttattgaatatttgagatataaatagattatattttagttgagaatgatgttattattattttttttttttaagaatggagaagtatgtgggtttttttttttttttttttttttttttatatttgtttaagtttttttagatagtaaatatgtatttttttttttttgaaaatataatgtggtaaataaatgtttaatagattttaaaagttttgttttttttaattattataaagatgttttatattgttggaggttagatatttaaatttatggtggaatgtttaattggtggtttttgttatgatatattattaatgttgattttaattttgtttgtttttaatatttttgatttaatttttagttttttgtgaaattgagaagaattagaatttagtattgttaagtgtaagttagttttttgaaaattattataataaaaataatagatgtgtaaatttatgtatattgtaatttgataattttaaaaatttattaggttgagtgtagtggtttatatttgtaattttagtattttgggaggtttagatgggaggattatttgagtttaggagtttgagattagtttaagtaatatagtgagattttatttttattaaaaaaaaaaaaaaaaaaaaaaaagttaggtatgttggtatgtatttatagtgttaattatttaggaggttgaggtgggagaattatttgagtttaggagatgaatgttgtagtgagttatgattgtgttattgtattttagtttagaagatagaatgagattttgttttaaaaataaaaaataaataaaagaaaaagaaaaaaaaattgttatgatgtttttttttttgaaatttttgttgaaagggatgtttgatatttttaattaagatattatttttatatatagttgtatatttggtttagtataatattttgtgtatttatataagtagttaatatatatatgtaaaaaattgggttatttgtaaatgggaataaaaaaataatagtttgatttagggtttaaaaaataaggaaggtaatgtttaagtttttaatgagttgaaaaataataaatattaatttgaatagaaattttaaaagttgataatttattttattagttttttaaattttgtatgtatatataaatatatataattgaattgaattaaattgtggtttatttaaatgttgggttttttagttgtgatgagagaagaattttttatttttttgagttttgtgatatgtagttgttgaggttattgttagttagagtagttaatagggagatttttttttttataaattaattagttttatttttagtttttattttttgattaattttttttttattgtgaagtaaattaataagtattgagattgtagttaatttgtgagggttatttattttttgtgggttatttatgatgttattttttttaggaaatattttgtgatgttttatttattgtgattattttttttttagggataatttagggaatattttgtttatttagtttttttttaaaaaaaaatgtttgttttattttaatatggagtatattattgttatttatttgttttttagaattttattttaatgattgtaaagtttttaaaagtataaaatattttttttttaatgtagaattatattttgtgttttatagataattagtatttagtgtgtgttttttgtttttaatagagagaaaaataagaatattagtttttttaatttatttttttgtttgtagttttttatagatattaatagaatttgtaattatgttatatgtttatagaaagtattaatagtatgttttgaaaaaaataattttttgaaaattataagggtaatatgtgttaattataggtaggaaatttagattttttttttaaaggtagattttaaaaggatttttaattttattatttaaagataatttttgttaaattttggagtatgtttttgtagtattattttaattttttttttataaatgaagaatttgaggattaaagagattaagtatttgataaaggttatatagttagtaaaagatagagtttagatttgaatttagttttgtttagttttagatttgttttatattttagaataaattgattaggtggttgatttttgttatttgattagtgaaggattttaggaaatgttattttaaaatatgttgttttggtatattgattatttttagttgaaggtatttaaagattagtaaatgtagggaggaggagagatatgtggaatagatgtggattaattttttgattgaatttaagttagatttttattagttaattttaagtttatttttagttaatttatatgagtttgagtaagaataagtaaatgttgtttaaggaaaaatttgggttggtttgttatttagaatttttgaggtaatagttaagagatataagggatgtgaagggtgaggaattatggaaaagtaaggttaaataatttgtaggtggtaaaattataaaggggtttttatagataaaaattattatgaggtttgttatgggggttgaagatgaggaagatagtaggattttaatttagatttttaggattatttataaattaaattgtatatatagttaaagaatatgggttgggtatgttggtttatgtttgtaattttagtattttgggaggttgaggtaggtagattatgaggttaggattttgagattagtttgattaatattgtgaaattttgtttttattaaaaatatgaaaattagttgagtgtggtg

SEQ ID NO: 607 - DNA, 7309 bp, Artificial Sequence
  chemically treated genomic DNA (Homo sapiens)
atgtgattaatggtgttaattgttttttggattgtttttatagtataggataagattatattagttttagtaggttttattgaagaaagtttatgtgttttgtagaaataagatttttagtttagtttaataggagattaattatatgtttattttatttttttttaaggtatgatagtatttggttgagatgtttgtgtgtattttttgtgtgaagttgagtatgtaatttttaaagaaattataaaggagttatttgtttttaaaggaaaaatatatgaattttatgggtataaggaagatattaaaatagggttggggagaagtttttttttttttattttatagtattttttatagaaataattgattgtttgaatatatggttattgaaatatatatatatatatatatatgtatatgaaaataagagttggaatatttgattttgttttttattttttattattttagataatataggatataatatggttttattgtatatatgtgttttttggtttaaaaatattgagagtagatttttgtggaaagaaatatgaaaatttgaggatttatgtgaatgtagttagaggtgaatgtagttagaggggtttttaatttgttggtagagttgggggagagttggggtaattttattgttatgaaattggttttagatggaggtaaggaaaggtgtttattttttgttggtgttagatatagagagattttgtagtattttgtattttaggtttagaattgtttagtgttgggtagtagttttattgagggtttggttagagtttatggggatgggtggattaggttgtttgttgtttggaaaaggttattttgaatataatgatttttatatggatggtggggtttgggggaaggtattgtggttagggtttggaggggaagagggaggaaagtaaagaggagtttttttatgaggtaatagaaatgatagtattttttttaggttgaatttttaaaatttagttttgttttggaagattgggattgtggtattttttgtagtgtttttagattgttttaaggtttttaaattaatgatttataattatgttgtttttttagagagtatttttttttttggttgatatgtggttagtttaggggtggaggagttttggtagttatgaatttagatgggatgttgattgagagttttgtggttatggtagatgggaggggtgagttttatttatttaaaggtatttgtattttattgatgagtgtggaattgtgtttttttgtttttgtagtgagatgattgattaggattgtaggttgagtaaatgggtgttttttggtttatagtgttttttagtattagttagtgggatagagttttgtgaattttttaaggagttattatttgtttgtttgaatgttggaaaggggttggtggtgttgattattggatttatttaattaatatttattaaatttgttgttattaatatttaatttttgtgttttaggggtttagattttagtaagggaaatagatgggtaaataattatattagagttagttaagtattgttaaagaagttgatatagggtgttgtggggatatatgggaggggaattagaggaggttttttggaggaggtgatatttaagttgaggtttgaaggatgtggaagagtttagtaatttttgaagattaaaaaaatggtgataaaaaagatatttttttaattttttagtgttatgatttaagagataaataagtaggtgaatgtataattatattgggttttattataagttagagtttgttttttttaggattttggtattataattttttttgaaattttgtttttggtattgatttttgggggaggtagtaatataggaatttagtgtttgttgtgaaattgatggatggtttttagttttgggtatgtttttatgtgttaaatttgtttaaatggtaggatttattttttttttagaagtatttatttgttttataggattttttatggaattttggagtttttgaggtgagagggattttggatattattgagttttattttttatttaataaatatagaagtggatgtttggataggtaaagtgatttgattaaggtaggtgtatagttattttgtaatattgggaataaattttaggttttttgattttttgtttttattttattttttttttattttttagaaataaagtttttatgtgtttttttttatagtgatatgtttggaatgtattagttagtaatttaggaagggaaaaaaataaatatataagagataaatttgttaggaggataaatttgtattgtttttgattggtttagagggtgattattattatggtagagaattatttaattagtgtaagtaaaatttttttgtgggttgggtattgtataaagatttaaatgaatttgtttatagatttgaaaagtagatatgagatttgtgaatggttggggtttttaagtttatagtataagtatgggttatattttatagtttggaggattgagttttgaaaatgggtaagtttttttatttttttgaattttattttttttatatttaaaataaggatgagtagtttttgaggttttttttatgatttttttttttatagattttagtattttataatttgatataaagagggtggatatgaatttattttttttagaaaagttttaggaaagagaatattaggttattttagtaggtgtgtagataggttagatagattttgaaatttatttagttttttttagatgtataattttattattgtttttagttgttaagagaaagtaggagagtttgtatttttattttttttttttttttttttttttttggagatggagttttattttattatttaggttagagtgtagtggtatgattttagtttattgtaagttttgttttttaggtttatgttatttttttgttttagttttttaagtaattgggattataggtgtttattattatatttggttaattttttgtgttgttagtatagatggggttttattatgttagttaggatggttttgattttttgattttgtgatttgtttattttggttttttaaagtgttgggattataggtgtgagttattgtatttagtttgtatttttatttttattgttagttttaggtttattttatttagtttattaagtgatgttgaataattaatttttatatattattaggtttatggatattatgatatttagattgatgggtgtttgttgaagggggtgattttagtaggaggatttttttatgtaaggatttatggagtttgttgttttttttttttagggtgagaattaaattgtttttatatggtgggtagaggggaattgatttaggtttggaataagagagaatattttaattgaaaagtttttggaatttgttgaattttaagatattgtgtggattagtttaggatagggagtgagaagaaattaattaaaaggtaattttgttattttttagttggaaaaaagattagattatatttgtgtttttataattaagtagttgttggaaaaaaatgttttagatgttttttatgagaaaattgttgtttgaagtttagtagaagttatttatttgatatttatattttaggtaaggttttttgttggagaaaatattggtattttggataaaattgaaatgtgaaaagaaagggaagagagggtttttattatgtaagatgtttatttaaagtggatttggtttggaaagttttttaaaattttttatatgattgtggaataagttatgtggggtgtggggataagtgaattttttaaattttattatgtatgtttttatttaatttggatttttagagtggtttttagggtattttgtttaggatttagttagttgttggttatatttatgttttttagttttttgagattttatttggttttgagagggttaaaaagtagtgtggttaaatattttaggttttaaagtatttttattgtggttggggaagtaatagaattatattttataaaataatgaaaatagtgttagaaaaatattgagagatagaaatatttttatgagttaggttatagttagagtgaaggtagggaaggtttttaaagttgggtggaggggataagttaaaaagatgtggaaattggttttttttttttatggttaaagtgtttaaaggggaaaaaggagttttaaaaatgtttttggaaatattattttttatgaattttttggtttttgttgttttaatgttatttgtttgagatgtaaatagaggagttttgagaaagaagttgaatttgtatttttttttgtttttatttgttttaaatttgtggtatttttaataggatgaagtggaagagaaagggaaagagataaaagtgtagaaagatggaagattttagttgtaaatggttatttgtagttagatggaatagttgttgatgtttagggaaatgtatgtttttttttagatgggaaggagtagtggaaaggggtgatgagtttttggttggttattaattattttatttttttgtgttggttttttatttggaaagtgggagtgatatttgtgtttgttttttttatttataaagattattgtgagagttataatatggtgagatatagaattttgtttttaaaaatataaagtagaattaagatgttaataataaggatagtaattgtgttagttatttgtaattatttattatagttagttgtttaggattttggattgtttttttggttttattatagttttggattagtttatttttaaattttttgttgaagggtggagttttgttagttatgggtagggaattatttttttttgtttttttattttttgttttttaaatatgtttagggtttttgtatttgttgttttttttgtttggtattttttttttgtggtttgttttagagttgatttttgtttttgtttattttttagtgaggatggtattttagggagttttttttttattattgtagagagagtaggttttttttagttatgtttaatttagaattttgttttgttttttttatagttttagtattatagaaaattattttgtgtatttatggatgtttatgggggtaagggttttgtgttgtttaatttagtattttgaattgtgtttgttgaatgaatatagaattttgtttgttttgggagagtatagaaaatagttttttattatatattatagttagttgtaaatagtagatggttttttatattttagagagtaagaattagagagagagagaaagagagagagtttgggttttttttttttgtgtttgttttttttagagaaattggaggggtagtagttagtatttttttgttggttttattaagtatagttaaggtttttaggatatggttattttttatttgtggaagtggttttgttggggtgggtgggtgttagttggttttggtttgggttagagatatttagtggtttaggtgggtgtggggttagggtgtagatgagaaggggtatgagggttttgttttgaggatttagtggtaagtattggttttgggtgtgttttagtttatttatttgtgtgtttatggtggtattattttttataaggatttgaatgatttgggggtggttttgttttgttattttttgtttttggttttgttttttttttggagggttgatgaggtaatgtggttttgttattggtttgagggggtgggttttaatagtttgaggtggggtttttgggggtttagtgttatattatttggttgtttaggtagtggtgtagagtgggtagtaggtaggtggtgggtgtttagatggtttttttttttttttttgtttttttagtttttgtttttttgttgggaggttgtttgttgagttttgtgttagtgttgaggtagttttgttgtgttttattttgttttgttgggtatttggagggtagtgtgttggaggttaaggttgttttgtatggtttggtgggtgagtgagtttgggttgtagtagttttgttggtggtgtgtatggtaattttggagaggtgagtagtagttttggtagtggtggtagtagtggtaatgattttttggtttgggtttattgtgtttttgggtagttggagtttgggggattggggtgttgaggtgtgtatatgtttgtttagttatttttaggatgttttttgtaattttgatattggtaagtgtttttggtgttttgtttgagttttatgttgtagttaggattgtagtgttgtttagggaggtagggtgagttttattttttttttttgttttaggagaggggtagatggggttggggtggagtggagaaatttgatgtttttgggtgggggtgttggtatagttgagaggggaagatgttttgtagaggaaatttatagtggttgagggagtttttggttgtttttgtttttttaatttaggttgtgaggtttttattggtttttttgatatttggaaaatgtttttatttattattaatggaggaagggttagaagagaagggtggggaaagggtttttaaaatttggaatgttaattaaagtgttgggaaattgaatagttaaaaaaaaaaaaaaaagttgtttgttatgtgtatggaaagttgtaggagaaatttggagtattttgagtttgtattattttttgtgtttatgaaatttattttttttattgagatttaatttagttgtaggttttttaggtaagtgttaattgagtttttgggattgttaagtttgggtggatttaagggggaaaatgaggagaaagttgtggtattgatttatgttttggaggtattgtgtttgagagtgttgatagttagtagaaggtgtgaggggttatttattatatagttgtgaaaatttataggaaggttattttttttttttttgaatgtgtgtggggagggggagaatgggtagtggaaaatagatttgttattaaaagaataaatttgttaagggttatattatggtgatagttttagattggatttagtgttttgagtagagagattttgtaaagagattttttattttttagtgtgtatggagggttttgagagtattttgggaggtttgtttgggagtgtttgggatatttgtgtttggatggttaaaggtggagtggtatttgggaaatatttttttttttttttttagtttataaag

SEQ ID NO: 608 - DNA, 7309 bp, Artificial Sequence
  chemically treated genomic DNA (Homo sapiens)
ttttatgggttggaaaggaggagagagatgttttttagatgttattttatttttagttatttaaatataagtgttttaaatatttttagataagttttttaggatgtttttggggttttttatatatattaaggagtaggaggtttttttatagggtttttttatttaagatattaagtttagtttggaattgttattgtgatgtgatttttggtaggtttgtttttttggtgataaatttgttttttattatttattttttttttttttatatatatttaagggggaaaaaaatagtttttttgtgaatttttatagttatgtggtgagtgattttttgtattttttgttggttattaatatttttaaatatagtgtttttagggtgtgggttaatgttatagttttttttttatttttttttttaaatttatttaaatttggtagttttagaagtttggttagtgtttgtttgggaagtttgtagttgggttgggttttagtgaaaagaatgaattttataggtgtaggagatgatgtagatttggagtattttaagttttttttgtaattttttgtgtatatggtgggtaatttttttttttttttttaattatttaattttttagtattttagttagtattttaagttttgggaattttttttttattttttttttttagttttttttttgttagtagtgaatggggatattttttagatgttaaaaggattggtaggaattttatgatttaagttaggaaagtaaaggtggttaggggtttttttagttattgtgagttttttttgtagggtattttttttttttagttatgttagtgtttttgtttaaggatattgagtttttttattttgttttaattttgtttgttttttttttggggtagaggaaaggagtggggtttgttttgtttttttaagtagtgttgtagttttggttgtagtgtggggtttgggtggggtattaggagtgtttattgatgttggagttgtagaaggtgttttgggggtggttgggtgagtatgtgtatgttttggtgttttagttttttaggttttagttgtttaggagtatgatgagtttgagttaaggggttattgttgttgttgttgttgttgttggggttgttgtttgtttttttaaagttgttgtgtgtgttgttggtggggttgttgtagtttgagtttgtttgtttgttgggttgtgtggggtaattttggtttttggtgtgttgttttttgagtgtttggtgggatgggatggggtgtagtgaggttgttttggtgttggtgtaggatttggtgggtggttttttggtgaaggagtaggagttggaggagtaagaggaggaggagaagttgtttgagtgtttgttgtttgtttgttgtttgttttgtgttgttgtttgggtggttgagtgatatagtgttgggtttttggggattttgttttgggttgttggggtttgtttttttagattaatggtagagttgtattattttattggttttttaaaaagggggtggggttgggggtaaggggtaatggggtggggttgtttttggattgtttagatttttatagggaataatgttgttgtgggtatgtgagtgggtgggttggggtgtgtttgggattggtgtttgttgttgggtttttggagtggagtttttgtgtttttttttgtttgtgttttggttttatgtttatttgggttattgggtgtttttgatttaaattagaattaattaatatttatttattttagtaggattgtttttataggtgaggggtggttatgttttagagattttgattgtgtttggtggaattagtgggggaatgttaattgttatttttttagtttttttggagagagtaggtatagaggagaaagatttaaattttttttttttttttttttttttggtttttattttttgggatatgggaagttatttgttgtttgtagttggttatgatatatgatagaagattgttttttgtgtttttttagagtaaatggggttttgtatttatttaataaatatggtttaggatgttgggttaagtaatataaagtttttgtttttgtggatatttatgaatgtatagggtgattttttgtgatgttagggttatgaagaaaataaaatagagttttgggttggatatgattggggagggtttgttttttttgtgatagtaagggaagggttttttgaagtgttatttttgttgagaagtggataaagataaggattagttttggggtaagttataggagagaggtattaggtagggggaatagtaagtgtaaagattttgggtatgtttgaaagatagaaagtagaaaggtaagaggaagtggttttttgtttatggttgatagagttttattttttagtaagggatttgggggtgagttgatttaaaattgtagtaaaattaggagaatgatttaggattttagatgattagttataatagatgattgtagataattaatataattattatttttattattgatattttgattttgttttgtatttttaaaagtaggattttgtattttattgtattatagtttttataataatttttgtgggtaggaaaagtaagtataagtattatttttattttttagatgaggaattggtatagaaagatgggatgattggtggttagttaggaatttgttatttttttttattgtttttttttatttgaagagagatatgtatttttttgaatgttagtagttgttttatttaattgtaaatggttatttgtagttgggattttttatttttttatatttttgttttttttttttttttttttgttttattttgttagaaatgttataagtttggaataaatagaaatagggagaaatgtaagtttagttttttttttagaatttttttgtttatattttagataagtgatattgggatagtagaggttgaagaatttgtgagagatggtatttttaagaatatttttgaaattttttttttttttttgagtattttagttataggaaagggaaattagtttttatatttttttgatttgttttttttatttagttttaaaaattttttttgtttttattttaattgtggtttaatttgtagagatgtttttgttttttgatgtttttttagtattgtttttattgttttatggggtatgattttattgtttttttaattatagtaggaatattttgaggtttgggatatttagttatattgttttttagtttttttagaattaaatagggttttaggagattggagagtatgggtgtggttaatagttgattgagttttgagtagagtgttttggaggttattttaaggatttaggttgaatgagggtatatgtggtggaatttgagagatttgtttatttttgtgttttatatgatttattttatagttatgtggaaggttttagaagattttttagattaaatttattttggataagtattttatatgatagaggtttttttttttttttttttttatattttagttttgtttaaagtgttgatattttttttaatggaaggttttgtttggaatataagtattaagtagataatttttgttgaattttaagtagtagtttttttatagaaagtatttgaagtgtttttttttagtagttatttaattatgaaagtataagtataatttgattttttttttagttgaaaagtaatgaaattattttttggttaatttttttttattttttattttaagttggtttatatagtgttttgaagtttagtgaattttaagagttttttagttgggatgtttttttttattttaaatttgagttagtttttttttgtttattgtgtgaaggtagtttggtttttattttaaggaaaagaaatagtaaattttatgaatttttgtgtaggggagtttttttgttagggttattttttttagtaggtatttattagtttggatgttatggtgtttatgagtttaataatatgtaagaattggttatttaatattatttaataagttaggtggggtgaatttgaggttaatagtaagaatgaagatgtaggttgggtgtggtggtttatgtttgtaattttagtattttgagaggttaaggtgggtggattatgaggttaggagattgagattattttggttaatatggtgaaattttgtttgtattaataatataaaaaattagttaggtgtggtggtgggtgtttgtagttttagttatttgggaggttgaggtaggagaatggtgtgaatttgggaggtggagtttgtagtgagttgagattatgttattgtattttagtttaggtgatggagtgagattttgtttttaaaaaaaaaaaaaaaaaaaaaaagaatgaagatgtaggtttttttgtttttttttgatagttaagaataatgatagagttatatatttgggaagaattgagtaagttttaagatttatttggtttgtttatatatttattaggatgatttggtatttttttttttggaatttttttaggaaaggtgagtttatatttattttttttgtattaagttataggatgttagagtttgtaggaagagaagttgtaaaaaggattttagaaattatttatttttgttttaaatgtgggaaaaataaggtttagagaagtgaaggaatttgtttatttttagggtttagttttttaagttgtaaggtgtggtttatgtttgtattgtgggtttggaaattttagttatttatagattttgtatttgttttttagatttgtagatagatttgtttgagtttttgtatagtgtttagtttatagagaaattttatttatattgattaaataattttttattatgataataattattttttgagttaattagaagtaatataggtttgtttttttgataggtttattttttgtgtgtttatttttttttttttttaaattattagttaatgtattttaaatatattattataaaaaaaagtatatgaaaattttgtttttgggaaatgaaaagagagtaaagtggaaataaaaaattaaaagatttgagatttgtttttaatgttgtagaatagttgtgtatttgttttggttaagttattttgtttgtttaggtgtttatttttgtgtttattggatgaaagatagaatttagtggtatttaggattttttttgttttaaaaattttaagattttatggggaattttgtaggataagtgaatgtttttgaaggggagatgggttttgttatttaaataggtttgatatatgggaatgtatttaagattgaagattatttattagttttgtaatgaatattgagtttttatattgttattttttttaagaattaatgttgaaaatagaattttagagaagattgtgatgttaaagttttaggagagataggttttggtttatggtggagtttagtgtagttatgtgtttatttgtttgtttgttttttggattgtagtattaaaaagttaggaaggtgttttttttattattatttttttggtttttaggagttattgaatttttttatattttttagattttagtttagatgttattttttttgggaaattttttttgattttttttttatgtatttttataatattttgtattaatttttttgataatatttagttgattttaatgtgattatttatttatttgttttttttgttggagtttaagtttttagaatatagggattaagtgttggtaataatgagtttaataagtattggttgaatgggtttaatgattagtattattgatttttttttagtatttagataggtaggtggtggttttttggagagtttatggagttttattttgttggttggtgttagggggtgttataagttagagaatatttatttgtttagtttgtagttttggttggttgttttattgtgagggtgggagagtataattttatatttattggtggggtgtgggtgtttttgagtgggtgaagtttattttttttatttgttatggttataaagtttttagttaatattttgtttgggtttgtggttgttggagtttttttatttttgagttggttatatgttaattaaagggggagatgttttttggggaagtaatatagttgtgaattattggtttgggggttttagggtggtttgggaatattgtagaggatgttatagttttagttttttagggtagagttgggttttggaaatttaatttggagaaggtattgttatttttgttgttttatagggaagtttttttttgtttttttttttttttttttttagattttagttatgatgtttttttttaagttttattgtttatgtgaaagttattatatttaaaatggttttttttaagtaatagatagtttggtttatttatttttatgagttttggttagatttttagtggggttgttgtttagtattgggtaattttgagtttaagatgtgaggtattgtaggatttttttgtgtttggtattagtagggggtaaatatttttttttgtttttatttggagttaattttatggtagtaaaattgttttagtttttttttagttttgttagtaaattgaagatttttttggttatatttgtttttggttatatttgtatgaatttttaggtttttatatttttttttatagggatttatttttagtgtttttaagttagaaaatatatgtgtgtagtaaagttatgttgtattttgtgttatttagggtggtgggaaatggaaagtagagttaaatattttagtttttgtttttatgtgtatgtatgtgtgtgtatgtatgttttaatgattatatatttaagtagttaattatttttgtgaagggtattatgaaatggaaggagaagaatttttttttaattttgttttaatgttttttttatgtttgtggagtttatgtgttttttttttaaaaatgagtagtttttttgtggtttttttgaaggttgtatgtttagttttatatagagaatatatataagtattttagttaggtgttgttatgttttgggagggaatgggatggatatgtggttggttttttgttagattgggttggaggttttgtttttgtaaggtatatgagttttttttagtggaatttgttggaattgatatggttttgttttgtgttgtggggatagtttaaagagtagttaatattattgattgtat

SEQ ID NO: 609 - DNA, 2501 bp, Artificial Sequence
  chemically treated genomic DNA (Homo sapiens)
agttgggattataggtgtatgttattatgtttggttaatttttttattttttatagagataggattttgttatgttgtttaggttggttttaatttttgaatttaagtgatttatttgttttgggtttttaaaattttgggattataggtgtatagtgttaggtttttatatttttatatatttttttgtttttttagttgtgaaatggagataatgatatagttttaatttatgtgggatgtttagtatagtgtttggtatttgatagatttttttttttttatttgaaatttatttttgagttgggtatggtggtttatatttgtaattttagtatttgggaaaattaaggtaggtagattatttgaggtgaggagtttaagattagtttggtaaatatggtgaaattttgtttttattaaaagtataaaaattatttgggtgtggtggtatatatttgtaattttagttattttagaggttgaggtatgataattatttgaatttggtagatggaggttgtagttgagttgagattgagttattgtattttagtttgggtgataaagtgagattgtttaaaaaaaaattatttttaatttaatataaaattttttgaatttttttttttttgagttgtttttttatttgagtttattttatattattgaatagttaattatagaattgtgtattattttttttgatttttagatttttagttttttatagtattttgtttttttttgttgtattagttatagttgtattttttttttttttttttttgagatagagttttattttgttatttaggttgtagtgtagtagtataattttagtttattgtaatttttgttttttgggtttaagtaatttttttgttttagttttttaagtagttgggattatatgtgtgtattattatgttaggttaatttttgtatttttagtagagatgaggttttattatgttgttaggttggtttagaatttttgattttgtgattagtttattttagttttttaaagtattgggattataggtatgagttattgtatttggttatagttgttattttatttgtgtgattgattattgtatgatgtttttattgaagtgtagtgaaggtaggaaatatgattggtttttataatatttttaatatttattattataggtggtatatagtagggttttaataaatatttgtaaaatgaataaagttaatgagtgtttatgtttgtagttttaattgttttgaagtaaatatttgattttttaatttttattagagtgttttgtatatagtaggtttaattatttttttttttttattaattatttatgttttgtaagaatttagttagttgattttttgtattttataagtgtgatgattgggtgtttttgtgtgagatgtgttatttttgaattttgttatgatgttggtatattgtgtgtttgatatgaagaaaaaaaaaatttagttagtttattaggtatagtggttaaggtttgtaatttttgtattttgagaggttaaggtaggaggattatttgaatttaggagtttgagattagtttaggtaatatagtgagattttgttttaaataataaataaaaataattagttgggtatggtggtgtgtgtttatagtattaattatttgggaggttgaggtgagatgattgtttgagttagggaggttaaggttgtagtgagttaagtttgtgttattgtattttagtttgggtgatagagtgagattttgttttaaaaaaaaaaaaaatattaaattttagaggggtgaaaaaaaattttatagtggaaatatagtaatgagttggtttagttttgtttttgttataatggtttatggtgttggaggatttttttgtgtatgtgtatagtttttggttggttatttttgtgagtgtgttttattttttattgagtgtgtgtgaagattatggaggttgatttgggagtgtgtatgtagttttgttttgtgtttgatttgtggattttgtggtgtttggtttgggtggtttggattgtggagggaatgttttggagggtggagaattgggatgaggttgaggtaggtgtggaggaggtaggtgttgaagagtatggttttgaagaagatggtggggaggagttgggtgttgaggagtttggtttggaagagtttggtttggaggaattgggtgttgaggaggagatggaggttgggtggttgtggtttgtgttgtgtttggtgaatttgtgtgagtttttttaggttattttttgtaattgtagtttgtgtgttgtgttgtttgtatggtttaattttgatggtgagttgtagttttatttaatgttgttgtttggtatgggttgttgtatttatagttattgaggtatgggtttggtgtttaggtttgatttagtagggatgatagtatggtttgaagtttttttattgttttggggtttattttgtagatgg

SEQ ID NO: 610 - DNA, 2501 bp, Artificial Sequence
  chemically treated genomic DNA (Homo sapiens)
ttgtttgtaaaatggattttggggtggtagaggggttttagattgtgttattgtttttgttgggttgggtttaagtgttgggtttgtattttggtagttgtggatgtggtggtttgtgttaggtggtagtgttgggtagggttgtggtttgttgttgaagttgagttatatgggtagtatgatgtgtggattgtgattgtagaagatgatttgggagggtttgtgtgagtttattgagtgtagtatgggttgtggttgtttggtttttattttttttttggtgtttagtttttttgggttggatttttttgggttggattttttggtgtttgatttttttttgttgttttttttagggttgtattttttgatgtttgttttttttgtgtttattttggttttgttttagttttttgttttttggggtattttttttgtgatttagattatttgggttggatgttgtgggatttgtgggttggatgtggggtggagttgtgtgtgtgtttttgagttgatttttgtagtttttgtgtgtgtttggtagaggatggaatgtgtttgtggaaatagttggttggaggttgtgtgtgtgtgtagaaggattttttagtattgtaggttgttgtaatggaggtgaggttaggttaatttgttattgtatttttattataaaatttttttttgtttttttaaggtttggtgttttttttttttttgagatagggttttattttgttgtttgggttggagtgtagtggtgtgagtttggtttattgtagttttgatttttttggtttaagtgattgttttgttttagttttttgagtagttggtattgtaggtgtgtattattatgtttgattaattatttttatttgttgtttgaaatggagttttgttatgttgtttaggttggttttgaatttttgggtttaagtgatttttttgttttggttttttaaagtgtagggattataggttttagttattgtgtttggtggattaattgaattttttttttttttatgttagatgtgtaatgtgttgatgttgtaataaggtttgagggtggtgtattttatatgggaatatttaattattatgtttataaagtataaaaagttaattaattgaatttttataaggtatgggtgattagtaaagagggaaaaataattagatttattatgtgtagagtattttggtggaaattggaaaattagatatttattttagagtaattaaaattataaatataaatatttattaattttgtttattttataaatatttattaaggttttattatgtattatttatggtgataagtgttgaaaatattgtaaaaattggttatgttttttgtttttattgtattttaataaaagtgttatatggtaattaattatataaataaaatagtaattatggttgggtgtagtggtttatgtttgtaattttagtattttgggaggttgaagtgggttgattataaggttaggagttttagattagtttgataatatggtgaaattttgtttttattaaaaatataaaaattagtttggtgtggtggtgtgtgtatgtaattttagttatttaggaggttgaggtaggagaattgtttgaatttgggaggtggaggttgtagtgagttgagattgtgttattgtattgtagtttgggtgatagaatgagattttgttttaaaaaaaaaaaaaaaaaaagtgtaattgtgattagtatgataaaaagagatagggtattatagaaggttaaagatttgggggttaaggaagatggtatataattttgtgattaattgtttaatgatgtgggatggatttaagtggagaagtagtttagaaaaagaagggtttagagagttttatattaggttaaaaataatttttttttagatagttttgttttattatttaggttggagtgtagtggtttagttttagtttagttgtaatttttatttgttgagtttaagtgattattgtgttttagtttttggagtagttgggattataggtgtgtgttattatatttaggtaatttttgtatttttagtagagatggggttttattatgtttgttaggttggttttgaattttttattttaggtaatttgtttgttttggtttttttaagtgttgggattataggtgtgagttattgtgtttagtttaaaaataaattttaagtagaaagaaaaaaatttattaagtgttagatattgtgttaagtattttatgtgaattaaggttatgttattatttttattttatagttaaggaaatagaagggtatataagaatgtgaaggtttagtattatatgtttgtaattttgagattttgggagtttaaggtaggtggattatttgagtttaggagttggaattagtttgggtaatatagtgaggttttgtttttataaaaaatgaaagaattagttaggtatagtggtgtgtatttgtagttttagtt

SEQ ID NO: 611 - DNA, 2401 bp, Artificial Sequence
  chemically treated genomic DNA (Homo sapiens)
ttattaaagaaaaaaaagatgatttattagatagttgttaaggtatttatataaaattatatgatagtaggatagatggtaattaagagggaatttaggatttgttattattagttggaaatatttgatttttagtttgtaaatgtgataagttagattaatattagtaggatattgaatatagtttgtagggatgagtttttgtgttatttttggatatgtgtttaagtaattagaataatttaaaatgttattaggtttttgttgttatttttataaattttgaatagtgagttgggtttttaaggaatttgtttttgttagtttattttatgttgtataataaataggtttaaagtttttggtagtgtatattaagtatggaggattttttatttattatgatagtttttttgttggagggttggggttgtattttatttttttttttggaaggggtggtttttgtttgaggttttatttgttttatagtagagggatgaaatggtaggattttggttttgatgggttttatttggtaatggtatatgttaagtgggttatgttttattgtttagagtaagttatatggttatgtttgatattgatgtgtgggaaatgtagaatttttttgtatttggggaggtagatatttggataatatgtaatttattatagggttagttggatgaagaatggttaagggtttaggttttttattttgagttaggttgaattagttggggttgtgagattaagttatggttattagtgtttgtttggaattatgttttgtttttgttgtgtttatattgtagtagggtttttgttttttaatttatttgaaattggtggtgggtgtggtatatagatgagaaataggaattttttatgttgggttttaataggagttgtggtgggaatataaatggtgtagttattttggaagatagtttggtggttttttataaaattaaatgtattttttatatatgatttgttatatattatttagtaattgtattttttggtatttgtttagatgagttaaaaatttgtatttatataaaaatttgtatgtggatgttgatagtagttttatttataattgtttaaatttggaagtttttaggaggtgagtgggtaaataaattgtggtgtttttggttagtggaatattatttagtgttaaaaagaaatgagtttaagttatggaaagatatgaaagaattttaagtattattaagttaaagaagttaatttgaaaaggttgatgttgtatgagtttatatttatgatattatagaaaaggtaaaattataaagatagtaaaaggattagtggttgtaggagttagggaggagggagggatgaataggtggggtatagaggatttttagggtagtgaaattattttgtatgatattgtaatggtggatataggatagtaagtatttgttttttattttgtagaatgtatggtattgagaatggatttttttgtaatatatggatttttagttataatattgaattttttttggggttttgtattgtttgtagtgttttttaatttttgtttttgttttgtttattgttttttttttttgttatagtgtgtttgttttgtggttgttaattagttgtgtgttttggttgtgtgttttgttttgtttttggtgggtgtgtgtgtggttaatgggtggtgtgtgggggttgggttgtggtggggtggggtagtggggtggttgttaattgttgtggtgttgttgaaattgaaaatattatattatgttaattgtggttgggtttgtgtgtatgggggtggggtttgtgtgtataaagggggtgtaggtgggttgggtgttttataggttaagtgtgttgtgtttgaggggtgttggttaggtttgagtgagtgagttagttagtaggtattgagggggtgtggttgttgtttggatgagataggtgaatttgatgtagaagagtttattattggatagttaggtagttgttgtgttttttgtatatgtagagttgggtggtgtggggttttttttgtgtttggtttttgtttttttttttttttttttttttttttttttgttgttttttttttttttgttgtttgtgtttgtgtagttttgggttatgtttgatgtgtttttttgtagtatatttatgatggagtgttttgttgtttgtgggatttttttagtattagtgtgtattagtgtttgttgtagtttttttgggttggtggattatgaggagttgagttgtgagttgtaggtttgtttggttgagttgaatgttgaggattagaattgttgggattatgatttttagtaggatatgttgttgtggggttttggatgtttgtagtggattgaagtgg

SEQ ID NO: 612 - DNA, 2401 bp, Artificial Sequence
  chemically treated genomic DNA (Homo sapiens)
ttattttggtttattgtaggtgtttagggttttgtagtggtatgttttgttggaagttgtaattttagtggttttggtttttggtgtttagtttggttaggtgggtttgtagtttgtggtttagttttttgtggtttattggtttgaagaggttgtggtaggtgttggtgtgtattagtattgggaaggttttatgggtgataagatgttttattgtggatgtgttgtggagggatgtgttggatatggtttggggttgtgtaaatgtgggtagtgagagaggagaggatagtgagaagaaggggaaaggagaggaggagagggtggaggttgggtgtaagggagattttgtgttgtttgattttgtgtgtgtgagggatgtggtggttatttggttgtttggtggtggatttttttgtgttgggtttgtttgttttgtttggatggtagttgtgtttttttgatgtttgttggttagtttgtttgtttaggtttggttggtattttttgagtatagtgtatttggtttgtggaatgtttagtttgtttgtgttttttttatatgtgtgggttttatttttgtgtgtgtgggtttggttgtgattagtataatgtagtatttttagttttaataatattatggtgattggtggttgttttgttgttttgttttgttgtggtttggtttttgtgtattgtttattggttgtgtgtatatttattgggggtggggtggggtgtgtggttggggtgtgtggttgattggtggttgtggggtgagtgtgttgtagtaggggaagggggtggtgagtggggtgggggtgggagttaaagggtgttgtgggtggtatggaattttgaaagggatttaatattataattgaaagtttatatgttataggagggtttgtttttagtgttgtatattttatgggataaaggataaatgtttattgttttgtgtttattattatagtattatataaggtagttttattgttttaaaaattttttgtgttttatttatttattttttttttttttttagtttttgtaattattgatttttttattgtttttgtagttttgttttttttataatgttatagatgtgaatttatatagtattagtttttttagattggtttttttgatttaataatatttaaggtttttttatgtttttttatgatttgagtttatttttttttagtattgaataatattttgttgattggaggtattatagtttgtttatttatttattttttgaaggtttttaggtttgggtaattatgaataaagttgttattaatatttatgtgtaagtttttgtgtggatgtaagtttttgatttatttgggtaaatattaaggggtataattgttggatggtgtgtggtggattatatgtgaagggtatatttagttttgtaaggagttattaaattattttttaaagtggttgtattatttgtgtttttattgtagtttttgttaaagtttagtgtggagagtttttgttttttatttgtgtattatatttattattaattttagatgaattaaaaaatagaaattttattataatgtggatatggtaaggataaggtataattttaaatgaatattgatgattgtggtttgattttatggttttggttggtttggtttggtttggggtgaagagtttgggtttttggttgttttttatttagttggttttgtaatgaattgtatgttgtttaaatatttgtttttttaaatgtaggaagattttgtattttttgtatgttaatattagatgtggttatgtaatttgttttgggtagtgaaatgtgatttatttggtatgtattattgttaaatggagtttgttaaagttagggttttgttgttttatttttttgttgtgagataaatgagattttagataggggttgttttttttaaaagagaaaatggagtataattttagttttttagtgaagggattgttgtggtgagtgagagattttttatgtttgatgtatgttgttaagagttttgggtttgtttgttatgtagtataaggtaagttgatagagataggttttttgaagatttaatttattgtttgaggtttatgggaatgatagtaagggtttggtggtattttgagttgttttggttatttggatatatgtttagaaatgatgtagagatttatttttgtaagttgtgtttagtgttttgttggtgttggtttagtttgttatatttgtaggttggaggttaggtgtttttagttggtagtgatgggttttgagtttttttttggttattatttattttgttattgtgtagttttatgtgagtgttttaataattgtttagtaagttattttttttttttttgatga

SEQ ID NO: 613 - DNA, 1508 bp, Artificial Sequence
  chemically treated genomic DNA (Homo sapiens)
attttataattataaatatttagtgtattttgtaaatatggtataatttgttggtataaaattttattgttttagaaaatattggtaataaaattatagaaaagttaaagatttttattttttattttgaagtgtttgggagatattttagaaatggatgggaaatgttaaattttgtatgtttgtttatttttttttttatattgattagatgtaaatgagtgttattaaaagtatattataggtatttatatagattttttttataagggatttataaagtttagatgtgaaatgtattttaaagggtttttagttgttttttatttttttttttgtgaaatagggaagatatatgtgtttttaagggtagagatggaatttgggttaatgggttggggggtggggggaagttggaagggattgttttaggatatggtaggatagtggattgtttttgttgttttgttgtttatattggggttttttgtaggtgtgttggttttttttttttttgttgagaagaagttttgttaaaatatttgttttttttgggaatttttttgtgggtttaaagtgggaaaatgttgttttaggtttaaaataatttgtttaagttttttagtgtgggagaaatgtttttatttgttttttgtttttgggggtgttttttgttttttgttgttagaattttggggagtgtttagatttggggtagtatatgtttgggttaattgtgagtagaataaatttttggtgggtggttaggaagtttttttttagttattgtttttttttagtgtttttttttttttttatataatataagattttttttttttagtttttttaaagtatagtttaaggaaatttttttatagtttttatttagttatgggttagtatgtttgggggtaaatatgtagatttggaggtaggtatttgtgggggggtgttggtttgggtgtgtggggaagtgtttgtttttgttatttgtttttttaaatattttgattgttgatttggttttttagttttttttttattttggagtatttttttggtgttggtattgttgaagaatgggtttgggtggggaggtgaagagaagttaggaatgttttatgtttttttaatggagagggggttttgggagtttttgagttaggaggatatggaaaaggggattggggttttgagattgggtttgttgggtttaagatgtgttttttggatgggtttaggatgtttttttgttgtgggaattttgtggtttggttttgtttgttgggggtttgaaaaagtggattgtagggtggaaggtgttatttatttgagttttggggatagtttttgggattttttgttaagtgtttaaaatggtaggtttttaagtggtgtgtggtgtttttgtattttttaaaatttttgaaatattttaaaaatttttttgtattttggtgtttggtagggttttttaaaaaaagtaaattttttttttaaatgta

SEQ ID NO: 614 - DNA, 1508 bp, Artificial Sequence
  chemically treated genomic DNA (Homo sapiens)
tgtatttgggagggaggtttattttttttggaaaattttgttagatgttaagatgtagaaggatttttgagatgttttaagaattttggaaagtgtaaaaatattgtgtgttgtttggggatttgttgttttgggtgtttggtggagagttttggggattgtttttaggatttgggtaaataatattttttattttgtaatttatttttttgaatttttagtaggtagggttggattgtggggtttttgtgataggggagtattttagatttatttagaaaatgtgttttgggtttaatagatttaattttaggattttaatttttttttttgtgtttttttagtttaggggtttttgaggttttttttttattaggaaaatataaaatatttttggtttttttttatttttttgtttaggtttattttttagtggtgttaatgttagaggagtgttttgaagtggaaagagggttggggggttagattagtagttgggatatttggagaggtagatagtagaagtggatatttttttgtatgtttgagttggtgtttttttatggatgtttatttttgagtttatgtatttgtttttagatatgttggtttgtggttggatgaaaattgtgaggaggtttttttgggttgtgttttaagggaattgaggaaggaagattttgtattgtatggggggaaaaaaaggtattggaggggggtggtggttgggagggagttttttggttgtttattaaaggtttgttttgtttgtggttggtttggatgtgtgttgttttgggtttaggtattttttaaggttttggtagtagagggtggggagtatttttgggggtagagagtgagtaagaatgttttttttgtgttggggggtttggatagattattttaaatttgaggtaatatttttttgttttgaatttatgggggggtttttgggggaggtggatgttttggtagggtttttttttagtagggggggagggagttgatgtgtttgtagagagttttggtatgggtaataaggtggtagaaataatttattattttgttatgttttaaggtagttttttttaatttttttttattttttggtttattggtttaagttttatttttgtttttgaaaatatatgtgttttttttgttttatagagggagggatgagagatggttaggaattttttagggtatattttatatttaaattttgtggattttttatggaaggaatttgtgtgggtgtttgtggtgtatttttggtgatatttgtttatatttagttggtgtggaaagaaaaataagtaggtatgtagaatttaatattttttatttgtttttgaaatgttttttaaatgttttgaaataagaaatgaagatttttaatttttttataattttattattgatattttttggaataatggaattttatgttaataggttatgttatatttgtaaaatatattaaatgtttataattgtagaat

SEQ ID NO: 615 - DNA, 1984 bp, Artificial Sequence
  chemically treated genomic DNA (Homo sapiens)
  unsure (9, 17, 18, 33, 41, 49, 50, 52, 54, 62, 80, 84, 127, 157, 159): unknown base
  unsure (175, 207..209, 214, 1181): unknown base
agttttagntattattnntatttttattaatgnttttgggnttataggnngngnttttttgnttaaatagtagttaatgnaggnattttaaaaggtatattattttatatttatttagtggttatgntattatttaatttttattataattttgtgngnttagtataatttgtgnttttattttatttgtgaataaatggaggtagnnntttgngtaatttataagtaagtggtagatttgggggttgtgtttagataatgtggttttagattttttgtttttttttgttttttgttgtattttgattgagtttagttatttatttttttaatatatattaattgttgtttttatgttttaggttttgtgttagatgttagaaatatatttttatttattggattttggtatggtttattgtttagtgttttgttatgttatgtgttatataatgtatttattttggtatttagtttatggaaaataatgttgaaagatattgtatgtatgtttttataataaaattatgtaatttatgttttttttattgttttggttattaggaagtttttatttaaattagagtaaatatattagaatttgggtttgttattttagtttgttgaatttttttttttggtttagattttttattttggtttataaattttattgtataaatgttttttattgtaaaatattttaaattttttttaagggaaggttgtatggaaatgatatagtaaggttttttttgtatttttttagatttttattagggaaggtagatttagatgttttttttatttttagttttaaagttttttatttataaaattttttaagtagtgattattgttgttttgagtatttggaggtagtttagagtttttgaaaggtaaaatttatatataaaaagaagttttttttgatttagattttagttttggtgttagatgtatatttgaggagtaggtggttagttagatttttatttgagtagttaataaaatttattgttttttaatggaattttttttgtaagtttgaattgatttgttatttttgtgatttgtgagatggtagggaagtattaaatattattatgatttgggttatagtggtgggaaaaaaggaaaaaagaaaaaaaaaatttattgttaagttttgttaggtgtanaaagggttggaattgttggggttattttatttgatttattggaaatagagtggattttattaatattttaataaagagaatttttttgtattaggttggaagtggttgttagttttttgtgtaattttattttttggaaaagtggaattagttggtattgtttagtgtgatttgtgaggttgagttttaatagtttaaagaagtaaatgggatgttatttttgtggggtttgttttttgtgaggtgtttattttgtatttgttatgtaaaatgagggagtgttaggaaggaatttgttttgtaaagttattggttttggttattagtttttatttaatgtttttgtgatgttgttgttgatttatttgggaagttggttggttggtgaggtagagtttttttttaaagtttggtttttatggaaaatatgtttagtgtagttgtgtgtatgaatgaaaatgttgttgggtgtttttagttggataaaatgtagttgagaattttgtttgttttgtgtgtttttttgttttaggtagggaagaggggttgttgggtgtgttttgtgttttgtttttgtatttggattgtttggtatgggtagggtgagggggtttttggggggttggggtttttggttgtggtggtgaagatagattggggtttggtagggaggttattttgagtttagagattttaggtattttttatatataggtttttattttggtgtgtgtgtgtgtgtgtgtgtgtgtgtgtgtgtgtgtgtgtgtgtgtgtgtgtgtgtatgtttgttaatgggagga

SEQ ID NO: 616 - DNA, 1984 bp, Artificial Sequence
  chemically treated genomic DNA (Homo sapiens)
  unsure (804, 1771, 1776..1778, 1810, 1826, 1828, 1858, 1901, 1905): unknown base
  unsure (1923, 1931, 1933, 1935, 1936, 1944, 1952, 1967, 1968, 1976): unknown base
tttttttgttaatgaatgtatatatatatatatatatatatatatatatatatatatatatatatatgtatgtatgttagagtgggagtttgtgtgtggggggtgtttaggatttttgggtttggaatgatttttttattgagttttgatttgtttttgttgttgtgattggaggttttgattttttgaaagtttttttattttgtttgtgttgggtgatttgaatgtagaaatggggtgtagagtgtgtttggtagttttttttttttatttgggataggagaatgtatagaatgagtggagtttttggttgtattttgtttgattagaagtgtttggtggtgtttttatttatgtatgtggttgtattgagtatattttttgtgggagttaggttttgaggagaggttttgttttgttagttagttaattttttaaatagattagtagtagtattatgaaagtattgggtagaggttgatgattaggattaatggttttataagatggatttttttttaatgtttttttgttttgtatggtagatatggggtgagtattttgtgaggagtgagttttgtggaggtggtattttatttgtttttttggattgttggggtttagttttataaattatgttgggtaatgttagttgattttatttttttagagaatggaattgtatgggggattggtggttatttttagtttagtgtaaaaagattttttttattaaaatgttaataagatttattttatttttaataaattagataaaatggttttagtagttttagttttttntatgtttggtaaggtttggtagtggattttttttttttttttttttttttttttattattgtggtttaagttatgatggtgtttggtgtttttttgttattttataaattataaagatgatagattaatttgagtttgtagaaaaaattttattaaggggtaatagattttattaattgtttaggtgagagtttgattagttatttattttttaaatgtgtatttggtattaaagttgggatttggattggaaggaatttttttttgtatatggattttattttttagaagttttgaattatttttaggtatttagaatagtagtagttattgtttaagggattttataaatggggggttttgggattgagggtaagagggatatttaggtttgttttttttaataggaatttaagaaaatgtagggaagattttattgtattatttttatgtagtttttttttagaaagaatttaaggtgttttataataaaggatatttgtgtaatagaatttatgaattaaaatagaaaatttgggttagaaggaaaagtttagtaaattgaaatgataagtttaaattttaatgtatttgttttgatttggataagagttttttgatagttaaagtaataaaagaaatataagttatatagttttgttgtagaaatatgtatataatgttttttagtattattttttatgggttaaatattggaataaatgtattatgtaatatgtaatatagtaggatattgagtaatggattatgttaagatttagtggatggggatgtatttttagtatttggtatagggtttggaatatggagatagtaattagtgtgtgttaaagaaatagatggttagatttaattaagatgtagtagaaggtagggaggggtaaggagtttggagttatattgtttaggtatagtttttggatttgttatttatttgtaaattatntaaannnttgtttttatttgtttatagataaaatgaaantataaattgtattgantntataaggttgtggtgaggattaagtgatgntataattattgaataaatataaagtgatgtgttttttaagatntttntattggttgttgtttggntagaaggntntnntttgtggntttaaggntattgataaagatgnnagtgatgnttgaagtt

SEQ ID NO: 617 - DNA, 17897 bp, Artificial Sequence
  chemically treated genomic DNA (Homo sapiens)
atattgtataattttttatttatgtttaaagtaaaggatttattatatattttgaatatagtttattttttatttttatttggaattgttttttttttatggttttttttttttttaatttttattgtttataatatgatattataggttaggtatgtttgtagataattgggataatttatttttatttaagtaaaaattttagatggtagtttttttatttgggattatgaagtaggtaggattttttttttttttttaatagagtttaagtagtaagattgaataagatgggatgaatttaaagagaaatatttgtatttgtttagttttttaattaatatttattgaatttttttatggttaggtgtgtaagatgttaggagggatgagataagatgatgatgatgatgatgatgatgatgatgatggtgatgatgatagtgaggatgagggtgaatattttaatgagagttttttatatgttagggattgttttaggtattttatatatattaatatatatatttattataatgattttgtattgttatgtgtattttatatatgaggaggtagaggaaggaaatgaaataatttgtttaagagtatagagtttgtaagtggtaaagataagatagaaataattttttaagagtagagagtggtgatttttggggatagggaagtggaaaagtggggagataaaggttgttgttttttttaataagttttgaagatttatttgattaggtttaagaaaaatttgataattattataaagtaaaaggaagaggagatgaggtgggtttttgggtatagatgtttgttttggaaagtttagggaggaaggggtgagaggaattgggttgtagtataggaatgggggatttgggaattagaggggattggttagggtgggttattgattgtagtgaatgtttatttgttgattgggttgtagtataggagtggggggtttggaattaagaggggattggtttagggtgggttattgattgtagtgaatatttatttgttgattagtttgatttagaagaaagggagagatggatgttggaggagagagggggttttgagggagtttaggattggaggtgggaagatatttttatggatatttttttattttgatagatagaaaagatgatggtttgtagtagtagatttataaattgtgattgaaaggtttgatggttttttttatttgttttttttatgtatagagaggtggagtaatttgttttaggtattatagtttataagtggtgaagttggagttgggggttatagattattgggtttttttttatgaatttttgttgtattttggttttttttaattttgagtatttatgagttttaagaaagatagttgggaataggtgatttttatggttatttttggaatatttggttagaatattttagtataaaatttaagttgttgttaagtagaaatttttagtggatattagtttagaaaatttaattttattttgtgatggatttgtagtgtgtgtgtatttattaagtaaatttgattttattgttgattagtgagaaagaggaataatgtaaatagttagtgtaattgtatttatatttagttttgtgagtttttgttattttagttggttgtggtgggggatgtggaggtgtatgtagtttttaggttttagtgaggggtttttgtatagggtgggtgttttttatgttttatgtgtatttaggtttgtattaaagatagttttttttttgtagtgtgatatttagttaagaaaattattttatttggtgtttagtggaagaaaatattttttttaatagggaaggaaaattggttgtgttgggttgagggaggggagtgtggaatttaaatggtgttttttttaggttttttttaaggtgatgtggattttgattttagaatgttattatttggaaaattgtgttttattgtttaaatttttgttttttttttttgtttttttttttttattttatttttttttttttgttttttgatttatttaatgttaatggttttttagaaggttaggttttttatataagtttagttttttgttaggtaatttttttggggttttaagttgtaaatttgggttgttttttgtattttgttttgaggatttttttaaagagataggtaagggttttttttggtaaaatgtttttttaattttatgtattagttttatttgttattgaagaagtgggttgttttttttgtgtttttgaatttgatattttttattttgatattttgtatttttgaatttgatatttttgtatttttagtaggtaaaaaattaaaggtgtttatttaataaattgttgtaatggggagtttatgggaaaatgggtatgtgtaagttggttaaaggataataggtatataggttgtttgatttgggagggtttttagatagtaggatggtttttagagatgtatttttgttgttgttgttgtttatgattatgtttttagggtttagaatggtgtttgggtatagtaggtttttaatatagttagggaatgaatgagtttattttaattatgttgtatggatggagaaattgtgttttggggttgtattatgttatgtatttgtagaaaatgtttttgtttttttagtttttttttagtggtggagtataggatttagtttataagagtagtttaattttgttatttgtggaatgatagaataaataagttttagggtttagggaggtaaggtttttgttttagttttttaagtagttggaattatagttgtatgttattaagtttatttgattttttatttttttgtagagatgatgttttattatgttgtttagatttttttggaatttttgggtttaagtaatttttttatttttgtttttgaagtagttgggattataggtatttgttattaggtttggttagtttttattttttttgtagagatgggatattattatgttgtgaaggttggttttaaatttttggatttaagagaggtttttgtattggttttttaaagtgttgggattataggtgtaagttattttatttggatataatattttatttgaaataagaaaaatttttttttattgggaatgttgtagttgaattagtttaaatttataaagaatggaagattgtttagtggttatttatttatttattaattttagatgttaaattttttagggtgggggaatgtgtttttatatttaaggtatttttgaatgtagttaaattttgtagtttagttaaattttatagttaatagttaaattttgtagtttagttaaatttttttagtagtaaaatttatgatattggaattttgttttttatattggttatttgtaatagaataatagagttttagtattagataggttttgaaagattattgaatttaattttttttttttgttagtgagaattttgaagtttagatttgttgatttgtgattgatagtgttaaagataggtttgaaatatagatgttttgggttttagaggtgttgtttgtttttttttatattttttttgttttagaaaatttttttttaaaattggttttaataattagaggggaaagttatggtttttgttttggggatagtatgggttggtatagaaaagaggtttataatttagtaggaagtgttgtgtgtgtgtgtgtgtgtgtttgtggaggtgtagggagggttatttgagtttgttttgggtttggttttgggtttagtggtaaatttaatgttgggtaggtggtttgaggataatgatggtgttagttgtgagttagattttttttatttataaaattatgtttttttatgtagtgttttttaatttggttgtatgttaggagttatttgggtagttttgtaaaaattttaatgtttagttggtttgtattttttgagattttgattaaattgttttggagtttatttttttttttttattatttatttatttatttattttttaatttggtggtttttttgggattttttatatgtagtaggggttgagaattgttggtttttttggttagatgggaatatgtaggttaatagttatgtataaatagagtagtagagtaggatggtgttaaggttggaaagggtgagttatgaaagtttaggaaattagaataggaaggggtgagaatttttttatttgggtttgtggggtaggagagaagagtttagtgggtaaggtttagtgagtgtgtttagaattgggaagatgaggggaagggtaagtgttgggtggtggtgggtaagatggatgagattaaatgggagtgaggattttagtgagagttttggtgatatggaaggttgagaattggagggagtttgttgggtgaaagtgaaggtggttgttgggtaggtagttgaatttggttggagagttgagttggtgagatttataggaagtgaagggagttgtttagggtgtggtgtaatgagatttttagaagaaattttgaggtagagatggggggtttttgtttatatggagatataaggaagtttatatgtatatgtatgagtgtgtatatgaatatgtataagtatataaatgttttttttgggtagggtatatgtgtttgttgtataggttgaggttttggatttggaggggattgtagagttgatttataatttgggttttgatgttttttttggttgtgtttttatgattgtttgtgtaataggtggtggttttagtgggtgtttgttgtgtgttgttggagtttagtttagtttggtgtgtttgggaggagggagtagggagtggggaaggggtgtgttttggttgtgtgttgggattgtgagggtttgggaggggtgaggtgtgggggtggggttgtggtgtttataaagttgttttttgtttggatgtaaataaattttgtttggtttttagttggtgttgaagtttgttagtttattatttgtttttggtttttgtggggtgttgggttgttagttttggtattgttttttttttttttttttgtgttaggtaagtttgtgttttttttttttaggtgtgatgtggagtagaaaggggttgtttgtgtggtgttgttggagtgttaggattgttttttgtagttttgtgtattttaggagtaagtgttttggagttgtaagtgtgtggttattttggggtgtgggtgtgagggggttttgggtgtagatattgttgaagtggggggtttaattatggaaagggaggaaaaaaagatagggttttatttattttttttttagttggggattggggttttggaggttgggaagggggtgatgagatggtttgaaaaaatattaggatagtgttttttggtgttgtttttgaattttagttggtgttgttggtaggggtgtgtgttggatgtgggtgtagaagggattaggtgagtgtgtgtgtgtgtgtgtgtgtgtgtgtgtgtgtgtgtttgtgtttgggaatggagagattgtgtgtgagtgtgtagatgaggggttggtagaggtgagtggtgttggtaaggaggttggagaggggggtgtgggtgtgtttggtttgtagattgggttgggaatgggtgtggatttgagaggttggtggtgttttagttttgtagtatatatagggtggtgtgtatgtgtgagtgtaagtgtgtgtgtggggggagggtttagggtgtgttatagtgtaatatgtgagttggagtaagtgtttgtgagtgttattgggtagggtgtgtttttggaggaatttgggattggtgtattggtggtgtgggagaagtgatttgggtgagaggggttttgtggatatttggtggttttttgagttggttggagttaggagtggtgttatttttgtttttgtttatttttttttgtttttttttttttttttgtttttggtgttggttgtttttgttttttatgggggaaaatagttggaattattttgatgtttttgggggatttgttgtggtttttgatttagttttgggaggagattttgggttgggtttggggaatgtggttggttttgggggaaatatgttgttatgtttttgttaaattagtagttggagttgggatttagtgggttggttttttatttattttttttttatattttttgtttgttgtttttgttgtttttgggggttttgaatagtatgtttttgtggtttggaagtgggagatgtttggtagtgggtgggggaggtagggtttttggttattttatgtttatttaagaatattttttttttatggatgttgggggtattttagtttgtttggtttttttaagttattgggaaatatttaatatttagaagttagttagtggttaggtaggagggtggtagatatttttataatatttattagttgtatgggatttttttttaagttgttttaaaagaatatatttaaatataaattttttgtttttgttgtagaaatgtagttttaaggtgaattttttagtttagattttttttgttgagaaattttggtgtttttattgagttttataaatgtgattgaaataagtaaggtatagagggggtaaattttagtgttttttttggaagggttgttttttggtggggaagatatatggttggagatgtagattggttttgtgtggtgtgtgtggtggtagagttagttttaggttggggtggtatagtgttggggatgaaggaaggtgtaagggagagagagggttttggtgtggatggaaaattgggtgtttttttgatttgtgattttttagttttgtgggattgtgttttttattgtatttgggtaaggaggaggatttgtttgttttgttttgtaatttggtttttggtttagtgtttggtaggtgggaggagttgaaatatgtatatgggatgaagtggatggttttgggttttttgttttatttttttgtgaattagtaggttgagttttgggtgaggtaatagattgtgtatgggtggaggtgttggtttttgtttttgagggattttggagtgtttgtttgggttttttgtgaggaagtttttttggagtaataaagtttgattatttggaatggaataaaaaatttatataggatttatttagtttaatttttttttattttatagatggaaaatgaggtatagggatggggagggatgtgtttaggttgaattgagttggagtttagttttgtgagaggtttttgggtgggattgaaggtagtggaaagggtttttggtaggattttgtttgtttgttatggaggggtgaaaggaaattgtatttttattgaatttttggtgaggaaatttttgaggttaaaggggtagagtggaatgattttttttaagtgtaaattaggtgtttttgagagattagtaaagttagtttgaagggtaggggtttagaggttgtagttttttgagttggtttttgattgaatggggttgttttttttttatgatagaagatagattttaattgagttgagggtttttttgggttatgttgaaatttgttggtttgaatttgtttttttatggatttgaaagaaagatagtattgtgttttttgggtggtttaaagttgtagtttttttttgggatttaattttagagaattttattttagatgtgatttagaggttttgttttgggagagaaagtgtgatgatttagtatttgagatttaagtagggtttaggtttgatttagtttggaaggaaggttagggagggatatgatatttttttttttttagagtagttattgtttttttttatttgtttttatttttgtaagaatgttgtttggattgtattgttttattgaatggatgaggtaattgaggttaggagagttttaggatttgtttgttgttatatggtttaggtgggagagttagattttgaatttggatagttggattttagagtttttgttttttttttatgataatatgttggggtgtttgaagaaattaggtttaaatgaaaaggtagttaggagttttatgttttagtttgtttttttgtaaaatgagagtaatagatatgatgttattagaatgtgtaaatattaatttgtgtaatttgagaatagtattgagtatgtggaaaatagtgtgtaggtgtttgttgttagtagtatttgtagaagatatttttaaggtatttttttggtaggtagagtttgggattttttgttttaaatttatttaaggttgtgaaagtgtttgtaaatgtttgatttaggtattgttttttgttaagtttatgtaggttgtataatagtgttatgaaaattttgtttgaaatgtatatttttaggtttggttttttgtgattttttttttattaggggatatgttgttgttttaaagtttttttggttgggttgggaatggggtattttgtaggtagatagagttgagaatttttgttttggaatgataggggagagaagaaggaaggtgtagttatatatgttgttgtatttttaggttattttgtgtttatagtgttagggaattagtgagtgtttagtaaatagtttttgtttgttatagtgttttggaggtttaatgtattatattagttaattgaggtagaagatattttttttattttttaggttagaaaattgaggtttaggttggtgatttttttgtttagagtttagtgagtggggttttgtttaaggtgagttttttgagttttttttattttttaatattgtgtttggaggttatttatattttttgggtttattttttgagaaggagtttgttttttggatttattttaggttgttgtttttgttttttttgatggttgtgtgatggaagtattgtgtgtttatttgttttttattttttaatttggagatagaggtaggttagatagtggttttggttgagaatttagtttaggtaggtaggtagaagggttggggatattgaggttttataggaaggtggttgtagaggtagagggttatgagtaggtgttaatttggagttgtgtttttggggtgggggttatgtgaaaagaaatttgggtttttttgggtggggtgtaagttttagtattatagaatgggaatggattatataattggggttataagtaggtttttttgatttagatttttgatttttttatttaatattgtttgtagatttgtttatgttttatttgtttgggttttatttttgattttttgagtttagtgggtttttttgtaattgagttggtagaaagtgaggttttttaatagtttgggggttttgagtgttttttttagtagtttaattttttttttttttaaatttgtggggagattttttgtagttatatattttaaatttgtatagagttttgtttgaagagaggtgggtgggggtttaggtttttattttgtttttttgtttttattttttgttttatttttatggaatttaagaagattttaagtaattttttttaaatatggatgtgagagggttatttaagaggtgggtttatggttttttttagttgggaatgtttattatttttttttttttttttttaattatggaattttttttttttttttagaaaggtttttttggttgttttttgttggaggggaggttgggttgggttttttttgggatttgtttatgttttttatgaaatttgagagtttgtttttagtaggtgttgtgttagtggtggtggaaaggatatttttattgattaaggaagtaatttggattattttgtatagataagattggaggtttattttggagggtggaaattgtaagattattttggggaaggattttgttagtgtggttagtattttattttgggataaagggttttgtatgaggaagttatttttttgttttttgttaatattggttttgtttgtgtgatttttataaattattttagattatttagtgtagtttatgtttgttttgtaattttataaaataattttttaaggagattagtgtttttttttggatttttagttatttattttgtttttttagatggttgttttttgtttgttaaataaattatttgtgttgttaaaattttattgagaatttttaggaagattttggttgtattgtagaaaagaggtgggttttgatgagatttttgatatttttttttttttgttgttgtgtttgggatatttttgttgatttttttggtgttgtgtttaagttgaatatatagtagtttagttttagttttagtttttttggatttatatttagggagtgaatgtggttttggtttgtttgagagggagatagtggggtttatttttttagtgattttttttttattttttgaatattaaatattattgatgttttttgggttttaggttttattgtaaagtataggggtttttgaggagtttttattgtggttttgttttttgatatttgtattgtttttttgattttgattgttttgatatagttttttaatttttaaattagggaatttttttgaaggtttagtgaatttatttatattgtttgttgagttgattagttaagaaagatagtttgtgaagattgttaatttttttattttttttagggttttgagttttagaagggttagaaaatattaagagagtttatgaattgttttgtagtttgattttaaaatttttttgggtaaagaaatgataaaggattgtatttatagtaaggtagggttatttagggtttattttaaggtggttttttttgaggtttaggtagaaatggtgttgtttttggtaattttttggggaagttgttatagtaaatagttatagtatatgttgattttttttttttttttaaaaatttgttttataaagagtataatgtgttggagagaatattggtttttatgtggttttaaaattaggtatgttatagagggtggaatttgggttagttgttgttggtgataattgatgttatttttgttagtaatttttgtttgttttttttttatttgttttattgaaggtttttaggggattgttgtttgtttttttttgagggaatgagtgttatatttgtatttataataaattagtgagttttttattttttttttagtagggaggaatttagatatgtggtttttggaagttaagtgggtttttgtgtttgtttttgagttttaggttatttatttgtgaattgggtataatatttagttttttttggggtaatttttttgaggagtaagtgaaatagtgtgttgagtgaatgtttttttaaagtattgagttggttgttttaggaaggtattatgggggagttgaaaatagagaattttttgggtgttgtgaagggagaaaagtttaagatgttggttttgttaaaagtttaagtttgtttatgatggtttagtggtgattgtagggtggaggagaggtatgtgattgttttagttgatttttatatgttgaaagttttatggttatgtgtagtttattttataatgttgtatttgggttatgggtggtggtgaggattgtggatatatttagggtaatgtgagattattgttaatattttttttaaggttgttttaattttaaagtagttagtttgatgtttgttgatttggggtatatattttaattttttgatgttttagtttttttgtttgttaaatggtgatatgttggtattttttttttagggtttttgtgaggtttaaaggaagtattgggtttagagtttagttagtgttatagatattgtttttggtgttgtttttgtggtgtgtttgtgtagggttatattgttgtttttttgtggttgttttttttggtgggtggaatttggaatttttagaatagattatggatgtttttttgttggatatttttttagttttattttgtgggagttgtggtggggtttaggagagtttgtttaagagggtgtgtaggtgggtggtagagttggagtaaggtattagttttaatagataggagtttgaggttggtagaagtgggggttttggtttaaggtgtggggttaatttggttagagttgagtttggtagggttttggtaagattttgtggtttttttgttttggtgaagtatttttttgtttgggtttttatttgtttgtaagtttgttgtggatagtgtgatttttatagatgtatattgtgtttattttatagatggagaaattaaggtttagagaggaagtgatttgtttagagttatggaataggaaagtggtagggtttttatgttttgatttttaggttagtgtttttgttgttttattgaggtttttgggaattataggttttgtgtgttttttttagttttttaggggttgttgaatagtttttaagtggtgttggattattgaagatgtttttgtttattgtttttttaggttttagggttatgggttatgttttttttttttttgggtagattttggttttggttttgtttggtatttgtgatttagtttttttttgatttttttgggtttgttggattggaagggtatttgtgtagttttttttgggtttttattatttattgatagatagtgttggtggagagaagggttttagtggtgatgtattgggtttgataattagaaattttggtggtatttgttgagtattttttatgtgtttttttttttgttgggattttaggattgaaatttaggttatatttttatagatgttttggtatttttaaggtaattttgaaaggaaagtatgttgatgaattaagtaattgtttgtttaattttttatgttatttttgaatttaagttttattgttgattattgggagtaggagttagtatgtttattgatagataagtaaattgaggtaaagaggttagatagttaggtatggtggtatatgtttgtaattttagttatttaggaggttggagtaggaggattatttgaatttaggagtttgagattagtttgggtaatatagtaagattttgtttttttaaaaaataagatgaataatatatttttaaaaagagatttgataaattatgtaggattatagagttaataaatggtgatattatggtttgtaagtttttttttagtttttggttattttttgtttttttggtattggtttttttggaattttttttaggtaggtggatgggaaaagaagtgaagatataggttggtagttggtgttgtgatttggagttttgtttttggtgttaagttgggttttagttgaaggagatttgttggaggggttttttttgtgttttttggggagtaaagatggttttggagatggagatatggtttgttagttttaagttattttaaaggtggggttggtgggttaggagttagttttggtttttttgttatgttgtgtgtggttttgttttgttattttatttgttggaggatttttttgatgttttttagtgggttttaatattttgtgattaggattttgtatgaggtagagggagggtaggagttggagtttagtaaggattttaagtttagggataggttttatttgttatatttgttaagttgtgagggttttaggtgtttgggaggagggagtaggagtggaagtattagtttgagttgttaaattaggttatgtattatttgttattttttgttggtagaaggagattatagatattagaagatagtagtttttgttagaattgggtttttttatgatttttaggtggtgattttgaattttagaaaaagtgttttggggagagtggagtgaaggaagagtgtgaatattggatttgattttattttagtttttgtgttgtagttagtagggtgagtttaggatagttggtagttgtttgggtttagtttttttttttgtgaatgaaggtggtggggagtgtatgtgtgtgtgtgagtgtgtgtgagtataaatgattgtggatgtgagagtttatgaaagtgagaatgtattagtgtgtaagaaagtgtgagtatgtgagaatgagtgtgtttgtgagaatgtatgtatgtgtgagtataagtgtgtgaatgtgagaatgtttgagtgtgagaatgaaagtttgtaagtgtgttagtgtgagggaatgtgtgagtgtatttgagagtgtgtgtgtgtgtgtgtgtgtgtgtgtatgtatgtattagattaaataagaatgtatttaattgatattttttggatattgttatttattaggaattattaaaattagttattttagaggagggtggatgttgtattaggggatatttggtaatgtttgtagatttttttgttggttgtagtgtggggtgtatgttgtgggtatgtggtgggtagaggttagggatgttgttgagtttttttttgtgtttagggtagtttttaaggtagaggttgtttgtggggtttaaatgttagtagtgttgagttgaggatttttgtttaggaggtatagatgttgttttggatgttgtttagatagtatttgttttgttttttagggggatagatagatagtggatatagtttagatgtagtttgatgagtgagtttaagggagtgtttgtttttttgggattgtgagttttgtgggggtaggaattgggtttgtttgtttatgatttttagatgagttttatagttagttttattattatagttggtgttatttttgttttgagttttgtgttgggtatatagaatttagtgggtagaaatttttgaataaattttgagttttttattttgtttttgtgaatttagatgttttttgagggttagtttggtggtgtgggggttgggagtgggtagattgtagggagttaagttttggggtggagtggggtttaggtttttttttttggtttgagttgaagtattttggttttttaaattttaaaatttttattttttaatatttttatatgttgaatttttttatatgattttttttggataaaagtttttgtaaaaaaagtttgaaaagttttttggttgaggtattagggataaggtaagggttgtttgatgggtttaatttgggagaattgaggtgagggagttgttttttttttattttataggttggttagatggtggattgttagtagttggttgggttaatttgtagagagtattttttgtagtttttggtttatgtggttttagtattgtaggatgtgattaatatgtaggttattttgaggtttgtagtttttatagtttttttagattagtgtaaagttttatttagttttttggtagattttagagtttaggatattttttaaatggtttaaaattaatggaattatttgggggataataaataatgttattagatattgttaaatgttttttgggagagaaaattttttttagtttagatatattttgtgattatttttagtagttttatttttggattttttaaaggtttttagtagtgagggggttgggttagagaaggttttattagtttttaaaagtagatgtttaagaatttgatatttttaggatatatagtgatttttttaatttattgttttatgtggtttgggaagttaagttgtaggaataaaaaaggtgttgggtagggtaaagaggttttattagatagaggaaatggggaaggtggatatttttgttttttttgttttggagaatgagagagttggtggagattgatagatattatgttttaatgtgattatggtttttggaagttaaagagaattgattaaattgggttgaattatagtattttttgagtttttttaaatgtagaatttgttttttagatattgtatttttggggtttagtaatgatttaaaagtgaattttattgaaagtatgttgttgagttatattgtttatttatttagagagggagttgtagtttgattttttgtttaggagagttttttgtgttgggagttagaggtagagaaaagaataagttatttgtttgatgaagtttatagataggattgtttgaatttatttggtgggatagtgagagttttttgattttattttggtgtgttttgttgagtagggtatgttaagaagtttttgtgaaatgagaagtttttttatttttagaatgaggggtggtgttggtagggttttgggtttttggaaggttttttaggttatgtaggtgaggtgttttataggttagggttttgggattatgaatttgttgaattagtaaggttaatagatgtgggttttttatgttttttgtttttaagttggtagttgtttaggaatgtttataaatataaaattgattttgtttttagaatgttttggagtatagattttaaagtttgtataaagttatttttgtggggttggttatttattggggaaaattatgttggggttttagattagagtattttagtggagagtaggatttgtttatggaatgttatgtgttggtataagggatggatttggggtggatttggggtggtttgtatttgttggttgatttttaagaggtgttttattaggtttttgggagtttttgggtttttagaggagttttaggtaggaattttagaggtttgtatttttttgattattgtatttgaggggttttgggtagtgtggggtttaggtttttattttgaagttggttgtgtgagggttttggttaggtgttttttatttagaaagtttggatttgtgaattgggtgggtggtttgggttttttttttttgttatttattttttttttgttggttttttgttgttgtttgtaagatttgattttattttgtattttttatgttttattttagggattgatgggtatttagtttttttaatttgattattgatttagaagaatatatgtttatatttttggtttttagatttagtttttggaggtatgtttaatagatagtattatttgtttaagttttgtattttagggagttagtggtagtattttaagtttttttgggttgtgttttagtttggttttgtagtttatatttttgtatttgttttgtgttagagtataggtaatttttttggtttattttttgttttgatttaggaagtgttttttgttttggaggtttttttttttataaaattgtattgtgtgtttaaatgtttgttaaattttttgatttaaggtttttttttgtttttttttttttttagtaggtagttgagagttttgtattgtggggtgtgtatgtgtgtttatgtgtatgtgtgtgtttgtgtgtttgtgtgtttgtattattaattttttgttagggttaattgtgaggttgaagtttgtattatgtttatatgtggtaagtattgtgtgagtttgtgttttttttttattgttatatgggggttgtttgattttgggattagtaatgtaggtttttttttagaatgtagtgagttgtattttgggtatggtgggtgggtttgaatttggtatggggatttgtttgtgaggttgatttatttattttattgggagggtggtgtttgtgagttttagtatttttttttaggaaatttattgtgttggttttaatgggaagattgggttgggtttatgggttgtgtgtataagggatttttttattttttgtagtgtattatgagggaggtgaagttgttgggtagagtgtaggtttggtttttttgttattggttttggatttgttttttttaggaaattttttagtaggaagtgttgattttttggtttttgtttttttgtagg

SEQ ID NO: 618 - DNA, 17897 bp, Artificial Sequence
  chemically treated genomic DNA (Homo sapiens)
tttgtaaggagataaaggttaaaaggttaatattttttgttgagaggttttttaaaggaagtaaatttaagattaatggtaagaaggttaggtttgtgttttgtttagtagttttattttttttgtgatgtattgtaggggatgaggaggttttttgtatatatagtttatggatttaatttagtttttttattggggttagtgtagtggattttttgggagaggatattgaggtttatagatattatttttttaatgaaatggatagattagttttataaataggtttttatattaagtttaggtttatttattatatttaggatgtagtttattgtattttagaaggggatttgtattgttgattttaaagttaggtagtttttgtgtgataatgaaaggggaatataagtttatatgatgtttattatgtataggtatagtgtaagttttagttttatagttagttttaatagaaggttggtgatgtagatgtatagatatataggtatatgtatgtgtgtgaatatatatatatattttatggtgtaggatttttggttgtttgttaaaagggaagaggggtagaggaaaattttaagttaaggagtttggtaggtatttgaatgtatagtataattttgtaagaaaaaagatttttaaggtagaaagtattttttggattaaagtaggggatggattagaggggttatttgtgttttaatatagggtaggtgtagaagtgtgggttgtaaaattagattgaagtatagtttaggaagatttggaatgttgttattgattttttggggtgtaaggtttgggtaggtggtgttatttattaagtatgtttttaagagttgaatttagaaattagaagtataagtatgtatttttttagattagtagttaagttagaaaaattaaatgtttattaatttttggggtgaagtataaaaaatgtagaataaggttaagttttatagatagtagtagaggattggtggagaagaagtaagtgataagagggaagagtttaggttatttatttagtttatagatttagattttttgaatggaaaatgtttgattaaagtttttatatagttagttttagagtgggaatttgggttttgtattgtttaaggttttttggatgtaatggttgagagaatgtaagtttttgaaatttttgtttagggtttttttgaagatttaggaatttttaagaatttggtgaaatattttttagaggttagttggtaagtgtgggttattttgaatttattttgggtttattttttgtgttaatatatggtattttgtgggtagattttgttttttattggggtgttttggtttggggttttagtatgattttttttagtagataattagttttataagaatggttttatatagattttggagtttatgttttagaatattttgaaaataaagttggttttatatttgtgagtatttttgggtagttgttagtttggaggtaggaggtatgaaaggtttgtgtttgttagttttgttaatttagtaggtttgtggttttaagattttggtttgtgggatattttgtttatatggtttagggagttttttagaaatttagggttttgttaatgttattttttattttgggagtgaaaggattttttattttataggagttttttagtatattttgtttagtaaagtgtgttagggtgaagttagggggtttttattgttttattaggtgggtttaagtagttttatttgtgagttttattaagtaggtagtttgtttttttttttatttttagtttttagtatgagagatttttttaggtagaaagttaggttgtaattttttttttgaataaatgagtaatgtagtttaatagtatgtttttagtaaaatttatttttaaattattgttaaattttaagagtgtaatgtttggaaaataaattttatatttaaaaggatttgagaaatgttgtggtttagtttagtttggttagttttttttggtttttagaaattgtgattatattaggatatagtgtttgttagtttttattagtttttttgttttttagaatagaaaagatagaaatgtttattttttttgttttttttatttggtgaaatttttttattttatttggtattttttttatttttatagtttagttttttagattatatgaggtaatgggttaaaaaaattgttgtgtgttttagaaatattaagtttttgagtatttgtttttgggagttggtggggttttttttgatttagtttttttattgttaaaggtttttgggaagtttagagataaaattgttgaggatgattatggggtatatttaaattaggggggatttttttttttaggggatatttggtaatgtttagtgatattatttattgttttttaaatgattttattgattttgaattatttaggaagtgttttagattttgaagtttgttgggagattggataaagttttgtattagtttggggggattgtgggggttgtaggttttggggtagtttgtatgttggttgtgttttgtaatattaaggttgtatgaattaaggattgtagaaggtgttttttgtaggttgatttagttagttgttggtggtttattatttggttagtttgtagggtgggaggagagtggtttttttattttagtttttttgagttgggtttattaagtagtttttattttgtttttgatgttttaattaaaaaattttttaaattttttttgtaggagtttttatttaaaggaaattatgtaaggaagtttaatatataaaaatgttaaaaaataaaaattttaaaatttaaaaagttaaggtgttttggtttaagttagggaaaggggtttgaattttattttattttaggatttggttttttataatttgtttatttttagtttttatgttattaggttggtttttaaagaatatttgagtttatggaagtaggatggaaaatttaggatttatttagaggtttttatttattaggttttatgtgtttaatatagagtttagaataaaaataatattagttatggtgatgagattggttatgggatttatttggggattatgagtaaatagatttagtttttgtttttatggagtttatagttttgaggggataggtatttttttgggtttatttattaggttgtatttgggttgtgtttattgtttgtttgtttttttggagggtagagtagatgttgtttggatagtatttaggatagtgtttgtgttttttggatagagatttttagtttagtattgttgatatttgggttttataagtagtttttgttttaggggttgttttgagtatgggaggaggtttagtagtatttttggtttttgtttattatatgtttatagtatatattttatgttgtgattagtaaaagaatttgtaaatgttgttaaatgttttttggtgtgatatttatttttttttggaatagttgattttagtaatttttagtaggtaatagtatttagaaaatgttagttggatgtatttttatttaatttagtgtatgtgtgtatatatgtatatatatatatatatatttttaaatgtatttatatatttttttatattgatatatttgtaaatttttatttttatatttagatatttttatatttatatatttatatttatatatatatatatttttataaatatatttatttttatatatttatatttttttatatattgatatatttttatttttatggatttttatatttatagttatttatatttatatgtatttatatgtatatgtgtattttttattatttttatttatggaggagggggttgggtttaagtggttgttagttgttttgagtttattttgttggttgtagtataggggttggagtggagttagatttaatgtttatattttttttttattttattttttttaaaatattttttttgggatttaaagttattatttgagaattatggaaggatttagttttggtagaagttgttgttttttggtgtttgtgatttttttttgttagtaggaaatggtaggtgatatgtgatttggtttggtggtttgagttggtgtttttatttttgttttttttttttgggtatttgaggtttttatggtttagtaagtgtggtaggtggagtttgtttttgggtttgaggtttttgttggattttagtttttgttttttttttgttttatgtaaagttttaattatagaatgttgggatttattagaaagtattaaagaggttttttagtaggtggggtggtaaggtagggttatatatagtatggtgggggaattagggttgatttttagtttattagttttatttttggagtggtttgggattgataaattgtgtttttatttttaaggttatttttgttttttaagaagtatagaagaaatttttttagtaggttttttttagttaaaatttagtttagtattaaaaatagggttttaggttatagtattagttgttagtttgtatttttatttttttttttatttatttgtttgggaggaattttgagaagattaatgttagagaagtgaaaggtagttaggagttgggggaaggtttgtaggttatggtgttattatttattagttttgtgattttgtataatttattgaatttttttttaaaaatgtattatttattttgttttttagagagatagggttttgttatgttgtttagattggttttaaatttttgggtttaagtgatttttttattttggttttttgagtagttgagattataggtatatgttattatgtttggttatttaatttttttgttttagtttgtttgtttgttaatgggtatgttaatttttgtttttaatgattagtagtggggtttaaatttaagaatggtatggagaattaagtaaatagttgtttaatttattaatatattttttttttagggttgttttggagatgttaggatatttgtgaggatgtggtttgggttttagttttagagttttagtgaggagagggatatatggaaaatgtttagtaaatgttattaaggtttttgattattaggtttagtgtgttattattggggtttttttttttattagtattgtttgttaatgagtaatgagggtttaagaggggttatataaatatttttttagtttagtagatttaggagagttagaggagagttggattataggtgttaggtaaagttaaggttaggatttgtttgaggaagaaaagaatgtgatttgtgattttgggatttgggagggtagtgggtagaggtatttttagtaatttgatattatttgagaattgtttaatagtttttgggggattgagggggatatatagagtttgtgatttttaaaaattttagtggggtagtaggaatgttggtttaggaattagggtatggggattttgttatttttttattttatgattttgagtaagttattttttttttgggttttggtttttttatttgtaaagtaggtatagtgtatgtttatggagattatgttgtttataataaatttataggtaaatggaaatttaggtaggaaggtgttttattaagataaaagggttatagggttttattaaggttttgttaggtttagttttggttagattagttttgtattttggattaaggtttttatttttgttagttttagatttttgtttgttaagattagtgttttgttttagttttgttatttatttgtatatttttttgagtaaatttttttgggttttgttataatttttatagggtgaggttgaaggggtatttagtagagaaatatttatgatttgttttagaagttttaggttttgtttattaggaagagtagttataggaaggtaataatgtaattttatatagatatattataaaaatagtattaggaatagtatttgtggtattaattggattttaaatttggtattttttttaagttttatagaaattttaggagggaggtgttagtatgttattatttaatagatggggaaattgaggtattaagaggttaagatgtgtgttttaagttagtaagtattaagttggttgttttaaggttaaagtaattttaaagggaatgttgataatgattttatattgttttaaatatatttatagtttttattattatttgtggtttagatataatgttgtaaggtgggttgtatgtgattatgaggtttttagtgtgtggaggttagttgggatagttatatgttttttttttattttgtagttattattgagttattatgagtaggtttgagtttttggtaaaattagtattttgaatttttttttttttataatatttagaaggttttttgtttttagtttttttatagtatttttttaagatggttaatttaatgttttggaaaagtatttatttagtatattgttttatttgttttttaaggaggttgttttgggagaggttgggtattatatttagtttataaatgggtaatttgaggtttaaaaataaatataaaggtttatttgatttttaaaggttatatgtttagatttttttttattgagggaaaggtgaaaaatttattggtttgttgtgggtgtaggtgtggtatttatttttttgggggagggtggataatagttttttggaggtttttagtgaagtagataaagggagagtaggtgggaattgttgataagggtagtattgattgttattaatagtaattggtttagattttattttttgtaatatgtttggttttaaggttatatgaaagttagtgttttttttagtatattgtgttttttatagaatagatttttaaaaggagggaaaaaattaatatgtgttgtggttgtttgttgtagtaatttttttagaaaattgttgagaatagtattatttttgtttgaattttaaggaaaattattttgagataggttttggatagttttgttttattgtggatataattttttgttatttttttgtttaaagagattttgaagttaagttataaagtagtttatgggtttttttggtgttttttggtttttttgaaatttaaggttttggggagggtgaggaagttggtagtttttatgaattgttttttttaattaattaatttagtaaataatatgggtggatttattggatttttaagaaagttttttagtttagaggttagggaattgtattagagtaattagaattaaggaaatagtataaatgttagagaataaaattatagtaggaattttttgagggtttttgtattttgtagtggagtttgaaatttaggaggtattagtgatgtttgatatttaaggaatgaaaaagggattattaagaaggtgaattttattgttttttttttaaataagttaaagttgtatttattttttgggtgtgggtttagaggggttggagttgaaattgaattgttgtgtgtttaatttgagtatagtattagggaggttagtaagagtgttttaaatataatagtaggaagagggaggtgttaggaattttgttagggtttattttttttttgtaatataattgagatttttttggagatttttagtggagttttggtagtatgagtaatttgtttggtagatagaagatgattgtttgaggggatgaggtgaataattggaagtttaaaggaggatattggtttttttagaggattattttgtgaaattgtaagataggtatgagttgtgttggatggtttgagataatttgtggaaattatataaatggagttagtgttagtagaggatgaggaaatggtttttttatatagaattttttgttttgagatgggatgttagttatgttaataggatttttttttagaatggttttgtagtttttattttttggaatgggtttttgattttgtttatgtaagatggtttaagttatttttttaattagtggagatgttttttttattattattaatataatatttattaaggataggtttttaggttttatgggagatatggataggttttaggaaggatttaatttagttttttttttagtagaggatagttaaggaggtttttttggagaaaggaggagagttttatgattaaaaaggaggaaggagagatggtaagtatttttagttgagagaggttatagatttattttttaaatggtttttttatatttatatttgaagagggttatttggaatttttttaggttttgtgggggtggggtagagggtgaaggtaggagaataaggtggagatttgggtttttatttatttttttttaaatagaattttatgtagatttaaaatgtatagttgtagaaagtttttttatagatttaaagaaaggaaagattaaattgttggggagggtatttaaggtttttagattgttaaggagttttattttttattagtttagttgtaagaaaatttgttggatttaaaaggttagagatggagtttaggtaggtagggtataggtaggtttgtaaataatgttaggtgggaaagttaaagatttgggttaaagagatttgtttatggttttgattgtgtaatttatttttattttgtagtgttggggtttatgttttatttgagggagtttaggtttttttttatatggtttttattttgagaatatggttttaggttggtatttatttatggttttttatttttgtagttgtttttttgtggggttttagtgtttttagtttttttgtttatttgtttgggttaagtttttagttaagattgttatttagtttgtttttatttttaagttgaaagataaaaagtaagtggatatgtggtatttttattatatagttattaagggaggtaggaataatagtttggggtggatttaggaaataagtttttttttaaaaggtgggtttagagggtgtgggtggtttttaagtgtaatgttggagggtggaaagggtttaggaggtttattttgggtagaattttatttattggattttggatagaagagttattagtttgagttttaattttttgatttgagaggtggaaagaatgttttttattttagttagttgatgtgatgtattgaatttttaaggtattatagtaaataagagttatttattgagtatttattaattttttggtattgtggatatagggtggtttgaaggtatagtggtatgtatgattatattttttttttttttttttttgttattttagagtagaggtttttaattttgtttgtttgtaggatattttatttttaatttagttaaaggagttttgaaataatagtatattttttgatggagagagaattgtaggagattgggtttggaaatgtgtattttagataagatttttatgatattattatgtaatttatataagtttagtaaaaagtaatatttaggttaagtatttgtaggtatttttatagttttgggtaggtttaggataaagggttttagattttgtttgttaagaagatgttttgagaatgttttttgtgggtgttattgatggtaaatatttatatgttgttttttatatgtttagtgttgtttttaggttatatagattaatatttatatattttgatggtattatgtttgttatttttattttatagaaaagtaaattgaggtatggagtttttgattgtttttttatttgagtttgatttttttaggtgttttaatatgttgttatggaaaaaaaataaaggttttgaagtttaattgtttgggtttaaagtttggtttttttatttgagttatatggtaataggtaaattttgaaatttttttggttttagttgttttatttatttaatggagtaatatgatttaggtaatgtttttgtgaggatgaaggtagatggagggagatagtggttgttttggagggagagagatgttgtgtttttttttggttttttttttaggttgagttaaatttgaattttgtttgagttttagatgttgagttattatgtttttttttttaggataaggtttttgagttatatttggaatgggattttttggggttgggttttaaggaagaattgtagttttgggttatttgaaaaatataatgttattttttttttaggtttatgaggaggtaagtttaggttagtggattttaatgtaatttaggggggtttttagtttagttgagatttgttttttgttatggggggggggtagttttatttagttaaaggttaatttagggggttgtagtttttaagtttttgttttttaggttggttttgttaattttttaagaatatttgatttatatttaaaaaaaattattttgttttgtttttttggttttaaaagtttttttattagaaatttaatgaagatgtaatttttttttgtttttttatagtaggtaggtaaaattttgttaggaattttttttattgtttttagttttatttaggagttttttataaagttgagttttagtttagtttggtttgggtatatttttttttatttttgtgttttattttttatttgtaaaatggaaagaagttggattaggtaggttttgtgtgagttttttattttattttaaatgattaaattttgttgttttaaaagaatttttttataagagatttaaatagatattttaggattttttaaaagtaaaagttaatatttttatttatgtatagtttattattttgtttgaaatttaatttgttggtttataggagaatggggtagaagatttagagttatttattttattttatgtgtatattttaattttttttatttgttaggtgttgggttaggggttaggttatagggtagggtaggtaaatttttttttttgtttagatgtagtgggagatatggttttataaagttaagaagttataggttaggggaatatttagttttttatttatattaaaatttttttttttttttatatttttttttatttttgatattgtgttattttagtttggggttggttttgttgttatatatattatatagaattggtttgtgtttttagttgtgtgttttttttattagaaggtagtttttttaagaaaggtgttggggtttgttttttttgtattttgtttattttaattatatttgtgaaatttaataagaatgttagaattttttaataggaagagtttagattgaaaaatttgttttgaaattatatttttgtagtaagaatagggggtttgtatttagatatgtttttttgaggtagtttaggagaaggttttgtgtagttgatgggtattataaggatgtttattgtttttttgtttggttattggttgatttttgaatattagatattttttagtagtttaaagaaattaaataaattgaagtgtttttagtgtttgtgaggaaggggtgtttttggatgggtataagataattaagggttttgttttttttatttattgttaggtattttttatttttaagttatagaggtgtgttgtttaggatttttagggatagtagggataataggtgggggatatgggggaggggtgggtaaggaattgatttattaaattttagttttagttattaatttgatagaggtgtgatagtgtgttttttttagaattagttgtattttttaagtttagtttgaaatttttttttgaggttgaattagagattgtggtggattttttaggaatgttgaagtaattttagttgtttttttttgtggagggtaggagtggttagtattagaggtaggggaggggaggaaagtgggggagggtgggtggaggtgaaaatgatgttatttttagttttagttagtttaaggggttgttaaatgtttgtgagattttttttgtttaggttattttttttatgttgttgatgtgttaattttgggtttttttgggggtgtattttgtttagtggtgtttgtagatatttgttttggtttgtgtgttgtattgtgatatattttggattttttttttatatatatgtttatatttatatatgtatattgttttgtgtgtgttatgggattgaagtgttattagttttttggatttatatttgtttttgatttagtttgtaagttagatatatttatgtttttttttttagtttttttgttagtgttatttatttttattaattttttatttatatatttgtgtgtaatttttttgtttttagatatagatatatatatatatatatatatatatatatatatatatttatttagttttttttgtatttatgtttagtgtgtatttttgttagtggtgttagttgggatttggagatgatgttaggaaatgttattttggtatttttttggattgttttattgttttttttttgatttttagaattttaatttttagttaggggggagatgaatgggattttgttttttttttttttttttttgtaattgaattttttattttagtggtgtttgtatttaaagtttttttgtgtttgtgttttggggtgattgtgtatttgtagttttggggtgtttatttttggagtatgtggggttataaagggtggttttggtgttttagtggtattgtatgggtggtttttttttgttttgtgttgtgtttgggagaagagggtgtgggtttatttaatgtgagggagaaaggaaaggatggtgttgaggttggtggtttagtgttttgtggaagttgagggtggatggtgaattgatgagttttagtattagttgggagttaggtgaggtttgtttatgtttgggtggagggtgattttataggtgttgtggttttgtttttgtgttttgttttttttagatttttgtagttttagtatgtagttgggatatattttttttttgttttttgttttttttttttgggtgtgttgggttgggttgggttttggtagtgtgtggtgggtgtttattggagttgttgtttgttgtgtaagtagttgtaggggtgtggttgggaggggtattggggtttgggttgtgggttggttttgtagttttttttgagtttagggttttggtttgtgtagtgggtgtgtgtgttttgtttggaggaggtgtttgtgtgtttgtgtgtgtttatgtgtgtgtttgtgtgtgtgtatgtggatttttttgtgtttttgtatgggtggaggttttttatttttgttttagagttttttttaagagttttgttgtgttatgttttgagtgattttttttattttttgtaggttttattagtttggttttttagttggatttggttgtttgtttagtagttgtttttgtttttgtttgataggttttttttgatttttagttttttgtgttgttaaagtttttgttgaaatttttgtttttgtttaattttgtttattttgtttattgttgtttagtgtttatttttttttttatttttttagttttaagtatatttattggattttgtttattgggttttttttttttgttttataagtttagatgagaggatttttatttttttttattttgattttttgaatttttatgatttattttttttaattttagtattgttttgttttgttgttttgtttgtgtgtaattattggtttgtatgtttttatttggttaaagaaattagtaatttttaatttttattgtatatgagaagttttagaggagttgttaaattaaaaaataaataaatagatagataataaaaagagagagatggattttagaatagtttaattagaattttagggggtgtaaattaattgggtattggggtttttataaagttatttaggtggtttttgatgtgtagttaggttgagaagtattgtatggaggaatatgattttatgaataaaggaagtttgatttatagttggtattgttattgtttttaggttatttgtttagtgttgaatttgttattgagtttaggattagatttagggtaagtttaggtgattttttttgtgtttttatagatatatatgtgtgtatgtataatattttttgttgaattgtaaattttttttttgtgttaatttatgttgtttttaaggtaggggttatggtttttttttttgattattagggttagttttggagaagggttttttggaataaaagaaatatggagaggggtaaatagtatttttaggatttaggatatttgtgttttaggtttgtttttgatattattgattataaattaataaatttgggttttagaatttttattggtaaagggagaggattagatttaatgattttttagaatttatttagtgttaaagttttgttattttattataaatgattagtgtgaagaatagagttttagtgttatgggttttgttgttagaagagtttggttaaattataaagtttggttattagttatgaagtttggttaaattataaagtttggttatatttaagaatgttttgaatgtaggagtatatttttttattttagaaaatttaatatttagaattaataagtgaatgaatgattattgggtagttttttattttttatggatttgaattagtttaattgtagtatttttagtgagggaaaattttttttattttaaataaaatgttgtgtttaggtagagtggtttatatttgtaattttagtattttgggaggttaatgtagaagttttttttgagtttaggagtttgagattagtttttataatatagtgatgttttatttttataaaaaagatgaaagttagttaggtttggtggtaagtatttgtagttttagttattttagaggtagaggtgggaggattgtttgagtttaggagttttagaaaagtttgagtaatataatgagatattatttttataagaaaataaaaaattaggtgggtttagtggtatgtagttgtagttttagttatttgggaggttaaggtaggagttttgtttttttaggttttgaaatttatttattttgttattttataaatgatagaattgagttgtttttatgagttgggttttgtattttgttattgggaaaggattgaaaaggtaaaaatattttttataggtgtatagtatggtatagttttaagatgtagtttttttatttatatagtgtggttgagatgaatttatttattttttaattatattaaggatttattatgtttaggtattattttagattttggggatatgattatgaataatagtaataataaaagtgtatttttgggagttattttgttgtttaaagatttttttagattaagtagtttgtgtgtttgttattttttagttagtttatatatatttatttttttataggttttttattgtggtgatttattgagtgagtatttttggttttttatttgttaaagatataagagtgttaagtttaaaagtgtggagtgttaagataaggaatgttaagtttaaaggtgtagggaaggtggtttatttttttagtaataaatggaattagtgtatggaattagaagggtattttgttaggggaggtttttgtttgtttttttgaggaggtttttaggatagaatgtgaagagtagtttagatttgtagtttgaaattttgaggaggttgtttggtaggaggttgggtttgtgtgggaagtttaattttttggaagattattagtattgaataggttagaagatagaggaaggagagtggagtgaagagaaaagagtagagaagggaggtaagaatttgagtaatggaatataattttttaagtgatggtattttaaaattagagtttatattattttggagaaggtttgaggaagatattatttggattttatattttttttttttagtttaatatagttaattttttttttttgttgaaaaggatgtttttttttgttgagtattagatgaagtagtttttttagttaagtgttatgttgtaggagaaagattgtttttagtataggtttggatgtatataaagtatagaggatgtttattttatatagaggttttttattgggatttgggagttgtatgtatttttatattttttattgtagttagttgaggtggtagaagtttatggagttgaatgtgggtgtaattgtattgattgtttatattattttttttttttgttggttagtagtagaattagatttgtttagtaaatgtatatgtgttgtaaatttgttataggatgagattggattttttggattaatgtttattggaaatttttatttaataataatttagattttatattagaatattttaattaaatgttttaaaaatgattataggaattatttgtttttaattgttttttttaaaatttatgggtatttggggttgggagagattaagatgtagtagggatttatggagaagaatttggtggtttgtggtttttagttttaattttattatttatgagttgtagtatttggggtaaattattttatttttttgtgtatggaggaaatgagtgagagaaattattagattttttaattataatttatgggtttattgttgtagattattattttttttgtttgttaaaatgaaaaagtgtttgtaaaagtgtttttttatttttagttttgggtttttttgggatttttttttttttttagtatttattttttttttttttttggattaaattaattaataagtaaatatttattgtaattaatgatttattttaaattaatttttttttaattttaagttttttatttttgtattgtagtttaattaataagtaaatatttattgtaattaatgatttattttaattaattttttttgatttttaagttttttatttttgtattgtagtttagttttttttatttttttttttttaaattttttaaaataagtatttgtatttaaaggtttattttatttttttttttttttattttgtagtgattattaagttttttttgaatttggttaaataagtttttaaaatttgttaggaaaaataatagtttttgtttttttatttttttatttttttatttttagaagttattattttttgtttttggagaattatttttattttatttttgttatttgtagattttatgtttttgggtaagttattttattttttttttttgtttttttatgtataagatatatataataatatagggttattgtgataaatatatgtgttaatatatgtaaagtgtttagaatagtttttggtatatagaaggtttttattaaagtgtttatttttatttttattgttattattattattattattattattattattattattattattttgttttattttttttggtattttgtatatttgattgtagagaagtttagtaaatattggttgaagaattgagtaaatgtagatgtttttttttgaatttattttattttatttggttttattgtttggattttgttaggagggaaaaggggattttatttgttttatgattttaggtggagggattgttatttgggatttttatttaagtaaaagtaaattattttagttatttgtaagtatgtttggtttgtaatattatgttgtgagtaatgaaaattaaaaaaaaaaaaaattatgaaaggaaaataattttaaatgagggtgaagggtaggttatgtttaggatgtgtaataaattttttattttgaatataaatgaagagttgtgtaatgt

SEQ ID NO: 619 - DNA, 2987 bp, Artificial Sequence
  chemically treated genomic DNA (Homo sapiens)
gggatagatggagtttaatttttttgagtttaaaataatttaaatataattattttttatgttttgttttttttttatttttgtatttaaatttttttttagataatagaataattaatgtttgataaggaagataatgatgatgattattttaaaatgaatttaggattgtaatgtaaaattttagtatttttttatagtatggattttaatatggtttttaatttaaattaatattagtagttttaattataaattttaaattttagtagatgtaatttatttttttaaaatgaaatagaagattgaaattattaaattattaaaaagaaaatgatttatgtttttagttgaaattttatgtaagattttatgtaataaataggagtgttataaatggaatgatgaaatatgattagaggaggagaaaggttttttagatgagatggaattttagttatttgtgttttatgaagaattagatgtgtatattaagtaaaatagttaaaaaaaaaatttttaagtgagttttttatttattttttttttataagatttttataaattgaggtatttggtgtagttttattttaggttttatgttgttatttttttgtaatgttaaggatttaggatataattgaattttttattttttattttttttttggtgtgtgtgtatatatatatgtatatatatatatatatatatatatatatatattttttagtattttatttttatatgtttttttttgagtattatttatgatagatgttaaataaaagtaaagatgaaattttaattgttaaaattttttttttatttaattaattttttatttaattatgttttaaaatgagaatagaaaattagttttaataagtttaggtaattgaaaagtaaatgttatgttgtattttgatttatggttataatttataattttggaaaagtggatagaaaagataaaagagtgaattttaaaatttgaatttattttattagtattttttatgaagggttagtaattaaaataatttatgtattagggagagaaatgttttaaggtatatgttttggatatttagtgtttttgtaaattttggttattgttgttttttttgtttattagaaggtaggaaattttatattggtgatttgtggagtttatattaattatttatagggtaattgtttaggattagtattatgaggagaatttattttttttgtttttttttttaagaaataaggagggggtgaaggtatggagaatagtattttttttgttgaaagtaatttagttataaagataaattatagttatgtatattgaaggtagttattttattttataaaataagagttttttaaaaagttatgtatgtatgtgttgtatatagagtagatatatagtttattaagtgttgttattaaaatataaaatatgttagttttttttaattttatttgttttagtttgttttgatgtgatttttttgattttttaaagatgtatagattagatatggtggtggtggtgggagaggggattttttgtgtttttggattttagggttgtttagatttttggagaggaagttaagtgtttttttgtttttttttggtattttatttaaggtgattagtttagaattggtttttggaagtgtttgggtaaagattgtgaagaagaaaagatatttggtggaaatttgtgtgtttggggtggtggaatttggggaggagagggagggattagataggagagtggggattattttttttgtttttaaattggggtagttttttgggtttttgatttttttatttttgtgggtaaaaaattttgtttttattgggtttatgtaatttttttaaggggagaggagggaaaaatttgtggggggtatgaaaaggtggaaagaaatagttattttgttatatgggtttggtttttagttttataaaaaggaaggtttttttggttagtgattaattgttatatgatttgtagtgagtgttaggagtatgtttaggaattttttagtagtgttttttttagttttatagttagatgtttttagatagtaaagtttatttttgtgttgtgttttgtttgttgttgtgatgtttgtttgtgttttgttgttgtgtgtggttttggtgtttagttatataggtgagtatttggtgttgtgtattggggattttggttttatgtatttgggtagagtttttgttttgattttttgggtttattttagtattttgatttttttttgaatagagaagttatgtgatttgggaaagagtttggattgttagagtttgaaagaattttgtggatattttagtttttttataagtattgattattatgagttagttatttaattgatttgagatatttttattttttaaatagggatagatgatattaatttgtaggttgttattatgataagataggatttgattaatatatgtgaattgtttatatttggaatttttttattgagtggaagaagttgttttaaatattttagttagtttttttttgtttttaggaaagtttggattatgttttaagataagtaaaatgttttaaaagtaagttgttttattttgaatttttttttaaatgttgattagtgtattagatttattttaatttggaaagtgaagtgttatttatttgaattttttaaaaatgttaattttaatatttaaagagttaattaagaaaagtttagtaatatgatgtattaagttgaatatgttgttatttttatttagaatagaaaattggtatttttatgttttatttattttaaggtaggttaaaaaattgtatttttatgattatttatatattttttgaatttattattgtaaagttgatttatagttaaataattaaatgtttaaattaagattaagatattagagaatgatttatttgttgttttttaattgtagt

SEQ ID NO: 620 - DNA, 2987 bp, Artificial Sequence
  chemically treated genomic DNA (Homo sapiens)
gttgtaattaaaggatagtaaataaattattttttagtgttttaattttaatttaaatatttaattgtttgattatgaattaattttataataataaatttaagaaatatataggtagttatggaaatataattttttaatttgttttagaatggataaaatgtagaaatattaattttttattttaaataaggataatagtatatttaatttggtatattatgttattaagttttttttagttaattttttagatgttaaaattagtatttttaagaagtttaaataagtagtattttattttttaaattaaaatggatttagtatattaattaatatttagggaaaaatttaaagtaaaatagtttatttttaagatattttgtttattttaaaatataatttgggtttttttgggagtaggaaagaattgattagaatatttaaaataattttttttatttaataaaaaggttttaaatataaataatttatatatattgattagattttgttttattataatgataatttgtaaattagtattatttatttttatttaggaggtgagagtgttttagattggttaagtaattggtttataatgattagtgtttgtgggaaagttggaatatttatggagtttttttgaattttagtggtttaagtttttttttaagttatgtagtttttttatttggagagaagttggagtattgggatagatttaggaggttagagtggaaattttgtttgggtgtgtggaattggagtttttggtgtgtggtgttaggtatttatttgtatggttgagtgttaggattgtgtatagtagtagggtgtgggtgagtattgtagtggtgggtagggtgtggtgtgggggtaggttttgttgtttgagggtgtttggttgtggagttgaaggaggtgttgttgaggagtttttggatgtgtttttgatgtttattgtaagttgtatgataattggttgttaattgagagaatttttttttttataagattgaaaattaagtttatgtgatgaaatgattgtttttttttgtttttttgtattttttataaattttttttttttttttttttaaaaaaattgtgtaagtttggtgggggtagggttttttatttatggaaatgagaaaattggaaatttaggaagttgttttaatttgggagtagagggggtagtttttatttttttgtttgattttttttttttttttttgagttttattgttttaggtgtataggtttttgttagatgtttttttttttttgtagtttttgtttgagtgtttttgagagttagttttggattgattgttttggatgggatattgggggagggtagaaggatatttggttttttttttaggaatttgagtggttttgaggtttgggggtgtagggaatttttttttttgttgttgttgttgtgtttggtttgtatgtttttagagggttgaggaagttatgttgggatagattggggtgagtaaggttaagaaaggttgatatgttttatgttttagtgatgatgtttaataggttgtatatttgttttatatgtagtatatatatatatagttttttaaaaaatttttattttgtggaatgaaatagttatttttagtgtatatagttgtaatttatttttgtagttaagttgtttttaatagaagaaatattgttttttgtatttttattttttttttgttttttggaaagagaggtgggaaaggtaaattttttttataatattggttttaagtagttattttgtaaatagttaatgtgagttttatgggttattaatataaagttttttgttttttgatggataaaggaagtggtgatggttagaatttgtagggatgttaaatgtttaaaatgtatgttttaaggtatttttttttttgatgtgtggattattttggttattagttttttataggagatattggtaaaataaatttgagttttaaagtttatttttttgttttttttgtttatttttttaagattatgagttgtgattatggattaaagtataatatagtatttattttttagttgtttgggtttattggggttaattttttatttttgttttggaatatagttggatgaggaattaattagatggaagggagattttgatagttggaattttatttttgtttttgtttaatatttattatgggtagtgtttagggaggagtatgtgagggtgagatattaaaaaatatatatatgtatatgtgtgtgtgtatatatatatatatatatatatatatattagaaaagaagtggaaaatagaaaatttagttatgttttaagtttttagtattataggaaaatgatagtataaaatttgaaataaaattatattaggtattttaatttgtagaagttttataagaaaaaaataaataagagatttatttggaggttttttttttaattgttttgtttagtgtatatatttgattttttatgagatatggatgattaaaattttattttatttaggaagtttttttttttttttagttatattttattattttatttatggtatttttatttattgtatggaattttatatgaaattttaattaagagtgtggattattttttttttgataatttaataattttaattttttgttttattttaaaggagtaggttgtatttattgaaatttgaagtttatagttagagttattaatgttagtttgggttagaagttatgttagaatttatattgtgagagagtattaaaattttatattataattttgaatttattttgaagtgattattattattgttttttttattagatattaattgttttgttgtttgaaaagagatttggatataaaagtgagggaaaaatagggtataaggaataattatatttagattattttaaatttaaaggaattgaattttatttatttt

SEQ ID NO: 621 - DNA, 5683 bp, Artificial Sequence
  chemically treated genomic DNA (Homo sapiens)
atggtaaatatttgaaaaagtttttatgttgaaatttaaattagattatatttaggatgttttataaggtggtattttttattaagatgataaaggataaatattggtggagttagagaggttgtttttaaatatagttttttttattagtaatattgtagtagtttgtatttattgtttagagtatgaaaaagatttttgttaaagatggtttttggggatttattattattatatgttaagagtttgttttttatgtttttatttttttattttgttaattttttttatttttattttttggtttagtgtgagattttattattttttttttttatttttttttttttatatttttggttttttagtaggttaatgtttttgtttttttattggaatttatttattttggttatttttttttttatgaatttgttggattatattttaaagttatttaaaagagggatataaagatataataaaattggaaataatgtttatttttattagtttgtagttaagagtgtgtggaattagggtggttgtaggtaaagagatagggggaagggttgttttatgttatgggtaggatagtaaatggtgtaaattttttggaaagtattttagtaatataggtgaagagtttttataatgtgtttattttatgatttatttttattttttttattttaaaggaataagaagaggtttaattaaagtatgagtgaaaaggttatttaaatatagggaaaggggttgttatgatgtttatggttttaagaaatagaaaataataatttggtttaaataataagtatataattaaagaaatttagaagtaggatttttttaagagttgagagatttagtagtttaaaaatgtgatttgatatatgagttttttttatgtttttgtttttttttttttaatattggttttatattaaatttggttttttagtggttaatagtattaaatagtatttattggtatttttgttggtatttaaaagagatggagaaagtttgattttatatggtttttttttaaaagtaataaaggattttttttggaagtttttagtaaattttgttagatttgaattatatgttaatttttaaattagttattggtagggaagtgggaaaaaggggaggaggtgtttatttttaattaatatgtttatttttgtttattgagattaattttataaaagtattgttttagttttttgaagaggagtataatgtttgtgagttatttattatatttatttattaagagttaagggataattgagtaaaatggtagagttggtaggaaaatggtgagtagttttgtttttttgtgttataattgatttgtatataaagagatttggaaatttaaatataagaattttttttttttaagtttagggttttgggtattttaagtttggtttttgtttgggtatagtggtttatgtttgtaattttagtaatttgggaagttaaggagggtggattatttgaggtgatgagtttgagattagtttggttaatatggtgaaattttaattttattaaaaaatataaaaattagttggatgtagtggtatatgtttggaattttagttatttaggaggttgaggtaggaaaattgtttgaatttgggaggtaaaagttgtagtgagttgagattgtattattgtattttagtttgggagatagagtaagattttattttattttttattaaaaaaaaattttggtttttatatgtgaaaaaataaaagttaatttttaaaaattaaataataaagagtgttaggtgataagttttatgatagagataatgtgtgttttaaaatatatagtataaaatagatggaaaatattttatggagaagggagagtttgaattggtgtttgattgaaggataagaaaaatttgttggtaatttttttttggttttgatttttgatgtagttaaagtaaagtaatttagaattatgatttagggaatatatttagagagaaatgaatttatgatgtttttaatttgaagatgttatgattttagattattttagaatataatgattttttattgttttatatttgtaagaaatgttttattattgaaaatttgtaatatttaaaaaatttttatataaaattatagtttattttgttgttttatgttaaataaataaaatatttttttttaattatgttgttttttttaattatatgtaattttaaaattagttgtaattgatagttttttttttatatttattgttaatgtatttaggttaattttatttttaattagagaaatttagaaaaaggaaattttatggtgaaatgttatatgttttataatttttagtaattaatttttaaggatgataatttggtaaaaaagagaattggattagttttttgaaaggtttattattttggtttatgttaattgattgttttaaaattatagtgtttttaggttgtagagatatatttaaaatggattattgtttttatattaaaggggataggtttttttttttttttttttatttttgttttttttaaagttgtatagaggtatatgaggtttggggaatatttgtagtatatgttggttggtaagaatgtgggtgaatttttgttaaggggtgtagatatttttttttttatgattttttttttttatttagaataattgaagtattatgataagaggaagggttttgtgtttgagataagtagtttttatatttgttagttttttttaataagaaagtttttttttgttattgtataggttatttttttattggtaaagtatgatgaagtttggaaattgttgtttttgttttgttgaaagaagttaagttttaagaaatttgtagaggtatttttataattttttagttatggtagtatgaattttgaaggggtagtgagtgttggtttttattttgtttgtatagttaagtttaggggagataatttttttatataagatgtattttgtttttgtgggttttttgtagtttttaagtttttatttgatttgtatataatgatttagtgggttagaggagtttagagttatgagtggtttatttttttaagaattatttttgattgtttagtattatggagtaagtggaaagaagaaaaaaaaaatttaattattttttgaagagtaagatgaatgttgtagaaggagaaggaaggggagggagatggatgggtgttgattttagaatttttagatttgtttggatgaattattatttatgatttgtgggataagaatttgattttatttattaattagtagaaatttttttttttgttttttaatatttgaaatttaataaatatgtgttttaggaatatattggttattttttagaggtattttatatatatattgagtaattagaaaatattttttttgtaatatatatatatatatatatatatatatattattttgttatataatatttttatgtaagaaaagtgaaattgttgtttgatgaatgtaaatatttggttgtttgtagtagttgggagttttgttaggtttaagtgttaagatgggaggtgaattttaggggtttttttttgtttgtgttgagatttttatttggttaagtttttatttatgttttggttttggagtgagtttgatagtgttggattatagtagagggagtgaggtggttgatgttttattttgaagagatgaatggaattttaggaagttagagttatgttggtttgggatagtggtttggagattagattttaatgatagaagtattaggtagtggtatttatggtaatgtgtgtatttatagaaatgtaatttatattttgggtttaggagttgaaaaatgaaaagaatgtttagggaggaaaaagggaaatataataataggtagagagtaatttattattttatgggtttgttttgtaaatagttgaagattttggagttagatggttttgtaaattttttaaataggagttatgttaagaagtatgagtgggtataaaaattgttttttaagatataattttaatttggtttgtggaaattggatatgagtaagtttttttaaaatttgagtagaaagtagttgttttttttgggttttttgatgagaatatgtatattgtttttaagtggttggttgagggagtgttgtggtagtgggagaggtgtttttgtgggttttttggtagttgtggtaggaaagggtttgaaggtagtgaaggtgaatgtggtgtattaatttgttggttttgttgatgttgtgtttatttttttttggggtgggtgtggggttagtttaggataggtgtttgggggatgtgtgtttttattttatggggatggtggaggagagttagtgagggtttgaggggtaggtattttaatgaatggtttttttggtgttttttgtgttttgttggtttatttttttttttataaaatgggtttagtttttagtatttattttttgttattaattaggtattttgggagattagtttgtttgaaagtttttgtgttattttgtgggtttttttaggtggtttttttagttttgtttttttttgggatgtttgttgattattttgagtttgtgtggtgtaagagtatgagtgttgagtttgtgtgtgttaaggttgtgtgggtgggtattgatttttttgagaagttttagtgtttttaagttttgatttttgttttttttattttttagttggaaagttgtgtgttaggtagtggggggtggagagaggagtttagattggtttttattttttgttttttgtttggttgttgtttattggttggaggaatttttaggaatgtgagtgtttttttaaaagtgtgtggtttttttgttttgttagttgttgtgtttgagttggtttgtgagtttagggtttttgttgttttttaggagtaatttttattttggatgtataggtattttttgtgtttttttagtttttgttgtttttgttattgtttttggttgttgtgttttggtatatataggtaagttgtttttggtggttgttgaggattaaagttgtttgggatatttatttggagtgttgaggttttagtttttttggtggattttggaatttatattttttttgtttgtttattttagtttgttttttttagttgttggaggattttttagggtaaggttttagagttattttttttagttttgaggtttataaattaatttattaggatattttaagatttttttattttttgaagttttttttaagtttttgtattagtattttagggaagagtttgtattttttttgttttttttgtaattttaaattatagtttttgattttgtttatttttgattttttaaaagtttttaaattgttggttttgtgttttttatattttaaaattagtattttttttttttattttttttttttttttttttttttttttttatgttttttggaaagtaattttgttgttttttattttagtaaatgtggggttaaagagggatggttttggttttgtttttatgtttagttttgtttttgtgtattgtttttttttgtttagttgatttttgatttttggtttttgtgttttttgttatagg

SEQ ID NO: 622 - DNA, 5683 bp, Artificial Sequence
  chemically treated genomic DNA (Homo sapiens)
tttgtagtaggaagtataagagttgagggttagagattagttaggtagggagggatggtgtgtagaaatggggttgggtatggggatagggttgggattatttttttttgattttgtgtttgttgaaatgaaggataataggattattttttagagagtatgagagagagagagagagagagagagagaggtggaggaaagagatgttggttttaaagtgtggggggtgtaagattaataatttgggggtttttgggaagttgaaggtgagtaagattaggaattgtagtttggggttgtagggagggtaggggaagtatagatttttttttggagtgttgatataaaggtttaaggaggattttagagagtaaggaaattttggggtgttttgatgagttggtttgtgaattttaaggttggagaggatggttttggagttttgttttgaagagttttttagtggttgagaggagtgggttggggtaggtgagtggggagagtgtaggttttggggtttattagagggattgaagttttagtgttttaggtggatgttttgggtagttttggtttttggtggttgttgggggtgatttatttgtgtgtattggagtgtggtggttgggagtggtggtgagggtggtgagggttggaggggtgtggggaatgtttgtgtgtttggagtagaggttgtttttggagagtgataggagttttgaatttgtaggttagtttgggtgtagtggttggtaaggtggaggagttgtgtgtttttaaaggggtgtttgtatttttggggatttttttggttaatgggtggtggttgggtaggaagtgggaggtgggggttagtttgggtttttttttttgttttttgttgtttggtgtgtaattttttagttagaaagtgaagggggtgggggttggggtttgggagtattagaattttttagaaaagttggtgtttgtttatgtagttttggtgtgtatgggtttggtgtttgtatttttgtgttatgtgggtttggggtgattagtaagtattttgaaaagggatggggttggggagattatttaggagggtttgtggggtggtgtaggggtttttgggtgagttgattttttggaatgtttggttgatggtgagaggtggatattagagattgggtttgttttgtaaaaagaaaaatgggttgatggggtgtaggggatattaagagagttatttgttaaagtatttgttttttgggtttttgttgatttttttttattgtttttgtggggtgaggatatgtgttttttgagtgtttgttttgagttggttttatgtttgttttggagggaggtgagtgtggtgttggtggggttggtaggttggtgtgttgtgtttgtttttgttgtttttgggtttttttttgttgtggttgttagggggtttatagagatgttttttttgttgttgtggtgtttttttggttggttgtttgggggtggtgtgtgtatttttattaaggggtttggggaggatagttgttttttatttgaattttaaggaaatttatttgtatttagtttttataagttaaattgaaattgtgttttgaaaaatagtttttgtgtttatttgtgttttttaatgtgatttttgtttggagaatttgtagaattatttggttttagagtttttagttatttatagagtagatttatagagtaataaattattttttgtttattattgtattttttttttttttttttaaatgttttttttattttttggtttttgaatttgaggtgtgggttatatttttgtgggtgtatatattgttatgagtgttgttgtttagtgtttttgttattgaagtttggtttttaagttattgttttaagttagtatgattttagttttttggaattttatttatttttttgggatgggatgttagttgttttgttttttttgttgtgatttagtgttattgggtttgttttgaggttagggtataggtagaagtttgattaaataaggattttagtatgggtagggggaaatttttggggtttattttttattttagtatttaaatttggtaggatttttgattgttgtaaatagttaagtgtttatatttattaaatagtagttttgttttttttgtgtgggagtgttgtatgataagatggtgtgtgtgtgtgtgtgtgtgtgtgtgtattatggaaagagtgttttttagttatttaatatgtatataaaatgtttttaaaagatgattggtatgtttttaaggtatatgtttgttggattttagatgttgggaggtagaaagaaaagtttttattggttgatgaataaaattagatttttgttttgtaaattataggtaatgatttatttaagtagatttgaagattttggaattggtatttatttatttttttttttttttttttttttttatagtatttattttgttttttgaaaagtaattgggtttttttttttttttttttatttgttttatgatattggatagttagaaatagtttttggagggatgggttgtttatggttttgggtttttttggtttattggattattgtgtataaattagatgggggtttgagggttgtaagaggtttataaaagtagaatgtattttgtatgaaaagattattttttttaggtttagttgtgtagatagagtagaaattagtatttattgtttttttaggatttatgttgttatggttgagggattgtaggaatgtttttgtagattttttggaatttggttttttttaataaaataaggataatagtttttaaattttattatgttttattaataagaaggtgatttatatggtggtaggaaagagtttttttattagagaaagttgataggtataggagttgtttattttaaatataaagtttttttttttattatgatattttagttgttttgggtggaaaggaaaggttatagaagagggagtgtttgtgttttttaataggaatttatttatatttttgttagttaatatgtgttgtaaatattttttaaattttatatatttttgtgtagttttgagagaagtagggatgggaaaagggaaaagaaaatttattttttttaatgtgagggtaatagtttattttgagtgtgtttttataatttggaagtattgtgattttaaggtaattaattaatatgggttgaagtgatggattttttagggagttggtttagtttttttttttgttaagttgttatttttgaggattagttattgaaaattgtaaggtatatggtattttattgtaggattttttttttttaagtttttttaattggaggtgggattgatttaaatatattggtagtaagtgtgaggaaagggttgttagttatagttagttttaaaattgtgtgtaattaaggagagtaatataattgagaaaaaatattttgtttatttagtatagaatagtaaggtgggttgtgattttgtgtaggaattttttaagtgttgtaaatttttagtagtggaatattttttataagtgtgaagtaatgaaaaattattgtattttagaatagtttaaaattatagtatttttaaattgaagatattataaatttatttttttttgaatatgttttttagattataattttaagttgttttattttaattgtattagaggttagagttaggaggaagttattaatagattttttttgttttttaattaaatattaatttaagtttttttttttttatgaggtgttttttatttgttttatgttgtgtgttttaaagtatatattatttttattataaaatttattatttaatattttttattatttagtttttaaaaattagtttttatttttttatatgtaaagattagaatttttttttggtggggggtgggatggagttttgttttgttttttaggttggagtgtagtggtataattttagtttattgtaatttttgttttttagatttaagtgatttttttgttttagttttttgagtagttgggattttaggtgtgtgttattatatttaattaatttttgtattttttagtagagttggggttttgttatgttggttaggttggttttaaatttattattttaggtgatttattttttttggttttttaaattgttgagattataggtgtgagttattgtgtttaggtaaggattagatttgaagtgtttaaagttttgggtttgggaagagagagtttttatgtttaaatttttaaatttttttgtgtataagttaattatggtatagaaggatgggattatttattatttttttattagttttattattttatttagttattttttagtttttggtgggtaaatgtggtgagtgatttataaatattgtatttttttttaaagaattgaagtaatatttttatggaattgattttagtgggtaggggtaggtatattggttaagggtaaatattttttttttttttttttatttttttgttagtgattgatttaggaattggtatgtgatttaaatttgatgaggtttgttgaaggtttttgggaaaagttttttgttgtttttaaggaagagttatgtgaaattaggttttttttattttttttggatattaataagaatgttgataagtgttgtttggtgttattggttattggggagttaagtttagtgtgaaattagtgttggaggaggaagaataaaagtatagaaagaatttgtatgttaggttatatttttgagttgttaaattttttaatttttaagggaattttatttttagatttttttggttatgtgtttattatttaagttaagttgttgttttttattttttagaattgtagatattataatggtttttttttttgtgtttggatggtttttttatttatgttttgattaaatttttttttatttttttagaataagagaagtaaggataggttataggataaatatattgtaaaggttttttatttatattattaagatgttttttagaaaatttgtattatttattgttttgtttatggtatgaggtagtttttttttttatttttttgtttgtagttattttagttttatatatttttaattgtaggttggtaagggtgagtgttatttttgattttattgtgtttttgtattttttttttgggtaattttgagatgtagtttagtaggtttataaagaaaagaataattaggatggatggattttagtgaaggggtaggggtattgatttgttaggaaattaagggtatggaggaaagaagatgggaaaaggagatggtgaggttttatattgggttgaaagatggaaatggggaagattagtaaggtaggaaggtgaggatatggagaataggtttttaatatgtaataatgataaatttttaaaagttgtttttggtaaaagttttttttatattttggatgataggtgtaggttattgtagtgttgttgatggggaggattgtatttgggagtagtttttttggttttattaatgtttattttttattattttagtaaaaaatgttattttatggggtattttaaatatggtttggtttgggttttagtgtggaagtttttttaagtgtttgttat

SEQ ID NO: 623 - DNA, 7833 bp, Artificial Sequence
  chemically treated genomic DNA (Homo sapiens)
gtttttggtgagatatgtgttttataagttttaatggagaaaaatgtaagtattttattttttgaaatttggttatttgagtaatgagaaaatagttattttttttaggatagtggtttttaattatggttatgtgtttttttaggaaaattttaaaaatatatatatattaatgtttttgtgttatttttagggattttaagtttttgaatatgaattttgtattagtattttttaattatttaggtgattgtgatgtgaaattatgattgagttttattgttttaagatgaaataaattttttttagtattgaaattataaatttaaattattaaaattaattaagggtatgggaattaataaggtatagggaagtttttatattataaaattatttttttaaattatagtttattgtttatatgttatttgttattgtagaaaagggtgaaaaaatagtaaatttaattatttttagtttgaaaaattatttagaaatgaagatgatgattttgaaatattgttaatattatttgatttataaataatgttttaatatatttattatatattgatagatatttttttatatgaatattatatattaaaattaaggtaataatgtatttagaatattttatttatatttatgtattttaagtaggttagaaattaagatatgagttattaagtatgagatgttaaggtgtggggttagaaattatattgtattttattattaataattaatatatattttaatattatatatatttaattttaatttgtatatttttaattatttttaattatgtgtataaatataagtatatatatttttatgtatttatttatttatatttttatttatttatttatataggggatttttttaaatttattattattaaattatatatttttattttaatttttagaataagtttaggaggtaggtattgttattatttatattttataaatgaggaaattgtttatagttataaagttattgtgttagatatattagaagtttaatatatatttggtgaatatatgtataaaaatagagagatagatatgtataatagtttatttttatattgagtaaaagtttttaatttgttttagaaatttttttgtgaaaattgagtaaaaattgaggtatttttttatttgttatataggtataggtggtattttatttttttaataaggatgaatattgaaatgtggattttaaggtttaattttagattttttgaatttttgatagtgggatttggaatttgtttattgttttaaagttttttaaggaatttatatgattaattaggtttagaaattattggattttattgttgaagtttgagaattaaagtttgggttttattgtggttttatagaaagggtaaatgaagtattatggatagaattgatatgtttttagttagtttttttttttagaagttaataggtagtaatatagtagaaattagtgatttatgttttgtgttttgaagttaggtagaattttatagagttttagtagtgttattgatgagatttgttttttggggtaagttgtttgatgtttttaaagttatattttttttatataaaatgagataatattttttgttttataggggtgttttaaagattaaataaaaataatatgttttattttatatggtataatgtttgatatttaagaagtaaaggatatattttatttttattgaagtaattagaaagtatgaaattatgaaggagataagagttttgattggtagtgtattttatttttttaggtttatttatttattttaaattatttttgttggagaataatttttaagttttttatttaagttgtgagtaattttatattttataatgatgttttttttatgagaaaaaaaaatgtttttaagttttttggagaaaatatatttgtattatttttattgaaaaatttaataattggattttgtttttttgtattaattttagagtgtatatgttataaataaagtgttttagtttaagaagattgaaagtaaatatggtatagtattttaaaataagaattttgtaaatatatggtatgattgtgttatattattagtaattatatgatatgtaatgtaaagtatagtttatagatttaaatttaattttaataagtaaattgattttgttttgttggggaaaagttaaagtattaatttaattgttaatgtagttttgtttatttttttggtatttagtgataagtttaaataatgtatatatttttatttatatatttagtaatataattttttgtttaatgagtgatgtttttttgttatttggtggtgtttgttagttttagaatttgttttttggtggtattataatattaagtatagagtaagtgtaataaaattgtagtatttttattgaaaaggttttgttttaaattgtttaataatttaaaggatttttgtggaagtaattgtatttgttaattagttataattagtaattaatttttttggagttttaatttatttttggtaaaatgttttaggaagagtatatattattagaaagtatgttaaaaatttatttagtagaaaatttaaaaatagtttttttttgttaagaggttttttaaaattttatttatatagttaaattttgaaattttagtaggttttgttttattattataattattgtataaatatttttaaggattttgtttttagttttaagtatgatttatttttataagtttgattagttattatattagttttgttatggaaaatgatatgtttttattttttgttgtagagttgttaaattttgatttatatttatgttgttttttttgttgaaagtttgtagtgaaagaaatttttaattttttgttttgtaatattagttggtagttttatttaatgggtattttgtttttttaaagaatttagttgttttgtttagaagttgattttttgatgtttttaatgtttggtttaattgatttgttttaatggagtttttgttggtgaggagtgagatgttattgattagaatgttgggatttgttgtttaattgttaggagtgagagatattgagatttagaaatttttggaggtgggaggggagagggatagttttggatggaggtggagatgtaagataaagggatggattttatataggaaaaaaaaaaagattttgttgaggtattgaggtgttgtatgattatattttttaaaggagaagttaaaaagtaaggaagtgggaggaggttggaggttaaagtatttaaaaggattatttgggtataatttgtttttttgttggtgtttgtaaaggatagatagttttgtttttaaagtatatgaatgttttttttaagtgattgggaatggatattaattgtttgttaaatgttattaaatgtttttttaaatttaggggatatagaaagaggggtataaaaggagaatttaaatagaaaaagggaggatttggaggtttttgaaagtggggggagaagaaggaggagggataatagagaggaatagagaaggagagtggagagaagataaataaaaataaaaataggaattattgaataattatatattaaaaagaaagtttttttttatggggtatttaaaatattgagattgtaatagtgattttggttatggaagaaagatgtttttttttatttttgtttttgaaagtttttggttttgttattggtgattaaaattttattaggttaaagagtgtgtttaattgtttgaagaatgtagtagatggaaggtgggttttgttatgttgtttgttttttttgttggagagaatgaaagaaatgtgtagagttagagatttttgttgagttagatttttttttgttgttttaggttattggttatttggtaaagatttgagtaaggaatgtagggttattgtttgggttaataaatggagtttgtttttttttttttggatgttgttgtttggttgatgtttttggtaatttatttgtggtgtatgtagaggagttttttttttttttttagattatttgttttgattaatttgattttttaaatatatttgattgtattttttaggtggatatattaataggttatgggttggagaggagtgggtgatgaggagagggatttaaatttgtgaatgtttgggttgggttggagttgtggggggtttgggaggagagaggggagaagagagaaggaaggagagtgtttgttgggatggttgagttgttttggtgagtagttttggggttgtatgtttttgtgggagatgttgttgttgtttttaggttggtaagagtggttttaatattattgttttttatttttttttttgtaaatttttagagaaatgtttttggtttttttgttgtgatatttttagtttgtatttttttatagtttaggtggtgtgtttttgtatgttggagtgttggttgttagtaggatgtttttttttgtgttgatttgtttttttttgttttgttgttgttgtttttttgatatttttgtttttattatttttagtttggagagatgttatttagttgtggtttgtatttgtggtttggggttatgtgtggaagaggggtgttagtttggattttgtttttggtagggggtgttttggagtggagagtgaggtgaatggtatatgagtgtgtgggtagtttattttgaagtttgagttttttatttgagttatgttttgtttagttttatttgggttagtgtttggtgagtgagtttatttgtggtttttgtggttgttttttttttgtatttttgtatttatttgttgattttttttttttgggatttgtattttgttttattaattagagtttgattgtttttttttatgtgattttgggtgggttgaggatttgttgttttttaaatgttagagggatgtgggtggtagagtttgagaggtggttgttgggttgtggggtgttttgattttttttttattttgtttttttgggttttatttgtttgtttttggatttttgtttttttttgttttttggttttttagagttttttttttatggtagtagttttttgtgtttttggtgtagttttttagtggatgatttttttgttttggggttgagtttagtttttggatgttgttgaaatttttgagattatgtgtgggtttggttgttgtttttttgttgggtgttattgttattgttgttgtttttgttgttgttgtttgtgggatgtttagtagtttgttgtttggtttttgtgattttgtgttttttggaagttgtttgttgttgtagagttgtatgaattagttatggtgttgtgggagtttttgtggtagtgtagtagttggatattttgtgagggtttttgttggttgttgttgttgtttgttatgttatttattgtagtttgtttggtgaagtttgttgttttttttatttttttaagtgattgttaaatgtttattggttggaattgttttggtaagtttagaatttttgtttttgattttttaattttgtagaagaatatgtgtatttagtatagattagtttattttagtgtgtttttttagttttttattttttattgttttagatttttaatattatttatttttatttagagaaataaggggaattgttgtaggtttgggggtgaggggtggttttgggatgggtagaaagtgtaggtgtagtaggaaatttttgtatgtttgtgtttatattggagttgtgaggattttgagaaatattaaatgggatggttttttgggtttattgttttgaaagagtattaattttaggggaaatattgaaatagaagttttgttattattaaagaaaaaagttttattaggatgaggaagaaataattttatgagaaagaatgagtgagaaagtaataaattaaatggtgattgtaggggaattgttgatttttggtaaaggtgttatgaggttgtattggttttttgttgaagattaggttatatagattttagaggagttgggttttaatagaatttttttttttttttttttttttttttttttttttttttttttttttttatttatttattttttttttttttttattttttttttttttaggtggtaaaagatattggttttgtagtttagatatgtttttttttttgtttttttaagttttaaggtagtataggggagttgagaaaaagaatattttgtgggttttttaggttggagtgggtatgattgaggttggttaggttttatgtaggtgagttgagggtggaattgattttagtgggtgttgatttttttatttttggataggtttttgtggagtgggttaggtattttttttgtttgtttgggtttttttagattttgatggtgaatgtttggtaggttttgttttgttgaagttttttaattaaatagggttagaggatgggagttgttgtatttttagttggtatagtatttggtttgatagtttgtagtatagggtgtatgtaattttttattttttgtgaatataattttgttgtagttaaatttggttttgaataaagtgttttttaaagatgtatataagttgaagtgtatgtaattttagagaggagggaatgattaattgtaatttagggtgaaagtttgtatagtttttagttattattgatgtaaatgttaaaaggaaaattattatgtattattttaatttattttttataaagataagttgagatatgtaattttattagatttgggttaatagattgtttttttttttggtagtttttaaatttggtattttaataaaatttaatatgtttttataattttttgatttatgtgtatatgtgtgttgtttttgaaagaataagttttattttgttattgtttaattattttttagatgttttattatggtaataattatgagtttgtaaaaataatttttggaaatgttgatggttttgtagtttaatatagattggtttgttttatttttagtttttgtattgttttaggaaataattaatttaaatgtgaagttgatatttgtaattaagaaattatatatttattagatattttaaaggggattgtataaattaaagagaataaattggttttgtagataggttgttaagaatttggtattttgtttttatttttgttaatttagaggtgattaatttttatttgagttaaatagattattatagaaaatattgtgtttgtttatttttattattgaggttttgttttttttttgtttggatatattttaaataaggggttgttttagttgttgaagtaaaagaataattaaagatggggaaatggtaaaagggtatttagagattattattagtttttttttaaaatgtggagttttgtggttataaatattgtttatttaatgagtaaaaaataaaaataaaaaaaaaataggaagtaaatgttaagtttttatttattattgttagtattaatgtaagttttaaaaaatagtattattagaaaaggatattaaaggagaattgattagaaaagaattgtggaaaatggaaatgaatattgattatttaattagattttgaggttattagtagatagtgattttgtagtatagttatagttgttggatttaaaatttaggataagtattttaaagttttaaagtagtgtttttttttgttaaaaatttgtaagatgttttaatgattggagtgttttttttgaatttgagg

SEQ ID NO: 624 - DNA, 7833 bp, Artificial Sequence
  chemically treated genomic DNA (Homo sapiens)
ttttaaatttaaagagaatattttagttattaaaatattttatagatttttaataaaaaaaagtattattttgaagttttaaaatatttgttttaaattttaaatttaataattatagttgtattgtaaggttattgtttattgataattttaaaatttagttaagtgattaatatttgtttttattttttataatttttttttagttaatttttttttagtatttttttttgatagtgttattttttaaagtttgtgttaatattgatagtggtgaatgaaagtttaatatttgttttttgttttttttttatttttattttttgtttattaggtggataatatttatgattataaaattttatattttggaaaagagttagtgatgatttttgaatatttttttattatttttttatttttaattgtttttttgttttaatgattgaaataattttttatttgaaatgtatttagataaagaggaaataaagttttaataataaagataaataggtatagtgttttttgtgatggtttgtttggtttaaatgaagattgattatttttaagttaataggggtggaagtggggtgttaagtttttgataatttatttgtaaaattagtttattttttttagtttatgtagttttttttaaaatatttggtaaatatgtaattttttgattgtaaatgttaattttatatttaagttagttattttttaaaataatgtaagggttaggaatgaagtaaattagtttgtgttggattataaagttattaatatttttaaaaattgtttttgtaggtttataattattattataataaagtatttaaaaagtgattaggtaatagtaaagtgaaatttatttttttaaaaataatatatatgtatgtatgaattaagaagttatagaaatatgttgagttttattaaaatgttaaatttagaaattgttaaaaaagagaataatttattgatttaaatttaatagggttgtatattttaatttgtttttgtaaaggataaattagaatgatgtataataattttttttttggtatttatattagtaataattaggaattatataggtttttattttgagttatagttggttatttttttttttttaaagttatatatattttagtttatatatatttttgaaagatattttatttagagttagatttaattatagtaaaattatatttatagaagatgaaaaattatatatattttatattataggttgttaaattgaatgttatgttagttaggagtgtagtaatttttattttttggttttatttaattaggaagttttagtagagtgaagtttgttaagtgtttgttgttagaatttgaaggaatttgagtgagtaagaagagtgtttgatttattttatagaagtttgtttagaaatggaggagttagtgtttattgaagttggttttgtttttggtttgtttatatggagtttgattagttttagttatgtttattttggtttgggagatttgtaaagtgtttttttttttaatttttttgtattattttgaagtttagggaagtaaagagaggggtatatttggattgtaaaattaatgttttttgttgtttaggagagaagggaatgagagagagagagagatagatagatagagagagagagagagagagagagagagagagagagagagagagagaaattttattgaaatttagtttttttagaatttgtgtgatttggtttttaatgggagattagtgtgattttatggtatttttgttaggaattagtgatttttttgtagttattatttgatttattgtttttttgtttatttttttttataaagttattttttttttattttagtaagatttttttttttaatgatgataaagtttttgttttagtgttttttttaggattggtgtttttttaaaatagtgaatttagaaaattattttgtttaatattttttaaaatttttgtagttttaatgtaagtgtaagtatgtaaaggttttttgttatatttgtattttttgtttattttagaattattttttatttttgggtttgtaatagttttttttgtttttttggatagaggtgggtggtattaggggtttagggtagtaggaggtgaggggttgaggaggtgtgttagggtaggttggtttgtgttggatatgtgtgtttttttgtggagttaaagggttggggatgggggttttggatttattagagtaattttagttggtgggtgtttggtagttatttaaggaggtagggaaagtagtgagttttattgggtgggttatgatgagtagtatgatgggtagtagtagtagttagtaaaagtttttgtaaagtgtttagttgttgtattgttgtggggatttttatagtattatgattagtttgtgtaattttgtagtagtaaatggtttttgaggaatataggattgtgggggttgggtagtgggttattgagtattttgtggatggtggtagtagaggtggtggtggtggtagtggtatttggtggggaagtagtagttaaatttgtgtatgattttgagagttttagtaatatttagggattgggtttagttttggagtgagagggttgtttgttgagaagttgtgttggagatgtgggaagttgttgttataaggagggagttttgggaagttggaggataggaggagatgggagtttaggggtagatgagtggagtttgaggaggtagggtggagggagagttaaggtgttttgtagtttggtagttgttttttgagttttgttgtttgtatttttttggtgtttgggaagtagtaggtttttagtttgtttggggttatgtgggaagaggtagttgggttttgattggtggagtaggatgtaggttttgggagggaggggttgatgagtaggtgtaaggatgtaaggaggaggtggttgtggaagttatagatgggtttgtttgttaggtgttggtttgagtggggttaggtggggtatggtttaaatgagaagtttgggttttagggtgggttatttgtatatttatatattatttgttttattttttgttttaggatgttttttattgaaggtggggtttggattagtgttttttttttgtgtgtgattttgggttgtgagtgtgggttgtggttgggtggtgtttttttgagttggagatggtgggggtggaggtgttagaggagtagtagtagtagggtagagaggggtgagttggtgtgggagagggtgttttgttggtgattggtgttttagtgtgtgggagtgtgttgtttaggttgtagggggatgtaggttgggaatgttgtggtggagaggttagggatgtttttttagggatttataggaaagagggtgagaggtgatggtgttagaattgtttttgttgatttggaagtaatagtagtattttttataagagtgtgtaattttaaggttgtttgttgaggtagtttagttattttggtaggtgttttttttttttttttttttttttttttttttttttaggttttttgtagttttgatttagtttaagtgtttgtaggtttgaatttttttttttattatttgtttttttttagtttgtagtttattagtgtgtttatttgggaggtgtggttagatgtgtttggaaggttagattggttgggataagtggtttgagagaaagagaaaggtttttttgtatatgttgtgggtgggttgttgggagtattggttgggtagtggtgtttgggaaggggagagtgggttttatttgttggtttaggtagtgattttgtgttttttatttgggtttttgttggatggttggtgatttggggtgatgagagaaggtttaatttggtaggagtttttggttttgtgtgttttttttattttttttagtgggaagggtaaatggtatagtgggatttgttttttgtttgttgtattttttaggtagttagatatattttttagtttaatggaattttagttgttagtaatgggattaagagtttttggggataagggtggagaggaatattttttttttatgattggggttattattgtagttttagtgttttggatgttttatagggaagagttttttttttggtgtgtgattatttagtgatttttgtttttgtttttgtttattttttttttgttttttttttttatttttttttgttatttttttttttttttttttttttgtttttaaaagtttttggattttttttttttttatttaaattttttttttgtgtttttttttttgtgttttttgaatttaggagagtatttgataatatttaataggtaattagtgtttatttttaattatttaaaagaggtatttatatattttgaaaatgggattatttattttttgtagatattagtagaaaaataaattgtatttgagtaatttttttaagtattttaatttttaatttttttttatttttttgttttttaattttttttttgagagatgtgattgtgtagtattttagtgttttaatgaaattttttttttttttttgtgtgaaatttatttttttattttatatttttgtttttgtttgagattgtttttttttttttttatttttaaagatttttgaattttagtgttttttatttttggtaattaagtagtagattttagtattttagttggtggtattttgttttttattgatgaagattttattaaaatagattaattagattagatgttggaggtattagaaaattggtttttagatagagtagttaaattttttaaggaaatagaatatttattagatagagttgttaattaatattgtaaaataaggaattagaaattttttttgttataggtttttagtagagaaggtaatataaatatagattaagatttaataattttatagtagagaatgagaatatgttattttttatagtaaggttggtgtggtaattaattaggtttatgaaaataagttatgtttgaaattaaaggtaaagtttttaaaagtgtttatgtagtaattatgataatgaaataggatttgttaggattttagagtttggttatgtaagtagaattttagagaattttttagtagaggaaaattgtttttgaattttttgttaagtaaatttttggtatattttttaataatatatgttttttttaagatgttttgttaaaagtaagttaaaattttaaaggagttaattattggttgtaattggttaataaatgtggttgtttttatagaggttttttaaattattaaatagtttgaagtaaagtttttttaatgggaatgttgtaattttgttgtatttattttgtatttagtgttatagtgttattaagaaataaattttgaaattggtaagtattattaagtggtagaagaatattatttattgagtagagaattgtattattgaatatgtaaataaaaatatatatattatttagatttgttattaggtattaaagaagtagataagattgtattagtaattggattagtgttttaatttttttttagtaaggtaaaattagtttatttattagaattaaatttaagtttatgaattgtattttgtattgtgtattatatgattgttagtaatatgatataattatattatgtatttgtaaaatttttattttaaaatattatattatatttatttttaatttttttgagttagaatattttatttgtggtatatatattttagaattgatgtagaggagtagagtttagttgttagattttttagtagaaatagtgtagatatattttttttagaaaatttaagaatattttttttttttatggaaagaatattattataaagtgtgagattatttatagtttaagtagggggtttgggagttattttttaataagaatagtttaagataaataaatgaatttgggaaaataagatatattgttaattagaatttttattttttttatgattttatattttttgattgttttaataaaggtaagatgtattttttgttttttaggtgttaggtattgtgttatgtaggatagaatatgttatttttatttaatttttaaaatatttttatgagataaagaatattattttattttatataaaaggaatatggttttgaaagtattaggtaatttgttttaagaaataaattttgttagtgatattgttgggattttgtgaaattttgtttgattttagagtataagatataagttattaatttttgttgtattgttgtttgttagtttttgagaggggaaattaattgggaatgtattagttttgtttatgatattttatttgttttttttgtggagttgtagtaaggtttaaattttaatttttaaattttggtaataagatttagtgatttttgaatttggttgattatatgaattttttgagaaattttgaaataatagataaattttaagttttattattagggatttagaaaatttggagttgggttttgggatttatattttaatatttatttttgttggagaagtaaggtattatttatatttatatgataaatgaaaggatattttgatttttgtttagtttttatagagaggtttttgagataggttaaaagtttttatttagtgtaaagatgagttgttgtatatgtttgtttttttgtttttatgtatatgtttattaaatatgtattaagtttttaatatgtttgatatagtaattttgtgattgtagataatttttttatttgtaaaatgtgagtaataataatatttgttttttgggtttgttttaaagattaaaataaaaatgtatggtttaatggtagtggatttggggggattttttatataaataagtgaatggaggtatgaataaataaatatataaagatgtgtgtatttatatttatatatataattaaaaatagttaaagatgtataaattaaagttaaatgtatgtgatattgaagtatatgttgattattgataatgaagtatagtataatttttaattttatattttaatattttatatttaataatttatattttaatttttagtttatttaagatatatagatatagatagaatgttttaaatgtattattgttttagttttaatgtataatatttatatgaaaaagtatttattagtgtgtagtaaatgtattagaatattatttataggttaaatgatattgataatgttttagagttgttatttttatttttggataattttttaaattgagagtaattaaatttgttatttttttatttttttttataatggtaaataatatataaataatgagttgtgatttaaagaaataattttataatgtaaaagtttttttatgttttattgatttttatgtttttaattaattttggtagtttaagtttgtgattttagtgttgaggaaagtttattttattttagagtagtggggtttagttatgattttatattataattatttggataattaaagaatattgatgtagagtttgtatttaaagatttggaatttttagaagtgatatagaagtattggtatatatatatttttaaagtttttttggagaaatatatagttatgattgagaattattgttttggggaaagtgattatttttttattatttaaatagttaagttttaggaggtaaaatatttatatttttttttattaaaatttgtaaaatatatattttattaaagat

SEQ ID NO: 625 - DNA, 7258 bp, Artificial Sequence
  chemically treated genomic DNA (Homo sapiens)
tttaataggaagtattaatagtttatgttttaggattttgtttttataattttgtaatattatattatgatatttaatttaatttttattaagttttgttaaaaatggattttaaattaagttgtaaatttttagtaatttggttttgtttttttttttttgatagtattattaaataaatttttttattgttgaaagtaataagtttggttttgttttatttattggttgtgttggtgatatttggggattgttattgaatagatgtatagagggagtttttataggtaggggtttttttgtttgtgttttttgggagagtatgttttgtatatttgttgtgtgatgaagattttatagttttatttagtgattagatttatagttttatttagttgtggtaagggggtttgaggtagttttaggtaagttggggtttagtgggagaagttgtagaagaattgattagaggatttaggaggttttagagttgggttgaggtagagagttttttgtgtgtttttttttttttttgtaatttggggattttttgtattggggtaggttttggtaggtgtatgggaggaagtatggagaatttataagttttttgattttttagtttagatgttgttgggttttttttgttggagattgtgttttttttaaatttttgtgagtgttgtggaagtatgtggggtttgggttgttgagtgttgtaagataggggagggagttgggtgggagagggaggggtggtgttggggtgggttttgatatagagtaggtgttgtgggttgtagtatagttggagattgtagtttggagtttgggttagggtttatttgtttttgtagtgttggtttgtgtttttttgttgtagttattggtgagtgttgtggttttgagatttttgggttggatgtgtggtggttttagtttttgagtgtttgtttgttttgttttgggttgtttgggttttttgggttttttggtggttgtatggagttaaggtgttttgttttgggtgttttttgtgggtgttgatttaggttgtttggagtttggagtttatagaggagagagatagttggggagtttggttattgtgggtattttttttgtgttgtagttgtttgtttggtttgtttttttgtttttttgttttttgttttgattttttttttttttgtagagttgttgtttagtgttttgattttgttattatgagagttttgttggtgtgtttgtttttttgtgttttggttgtgagtgattttaaagtgagtgtgtttttgttttgattgatgttgtttaaggatttttgattagtattaggggagaggaggggttgtttagggagttggggtttttggattttatttatagtagggttagattttttttaggaaatgggatagggtggtagtggaggtttgagaattatgggggttggtattggttggtaagggaggaagagggttattgggattgttttagtttgtgggtatttggtagatgaagtttaatttattttttttggttggaaattatggttttttatttgagaattagatatgaatagggtgaggtgagagggagagggaagagtgggttttgggattggggttagtttatttttattttggatttttggagtatgggatttttgatgaagtttttttttgaattttttttagggtagtaatgaattttattaagttttatgtgagtatttatttttataatagttggttgtatagataagttgggaaggttttaggggatatttttttttttgttttttgttgtagtgtgtgttattttttattatttttatttttttttgtttattttatttttgttttttttagtgaattgtgattgtttaaatggaggaatatgtgtgtttaataagtatttttttaatatttattggtgtaattgtttaaagaaatttggagggtagtattgtgaaataggtatggggatttttattgtaattgggagagaaatttggggatagggagggatgggtgggaggtaagagtaggtaggagttaggagttggaggtagggtgggtgatatttttatttttatgtgataagtataaatatatatatatgtttatgaaatagtggttatataaatgtgaggtggggttggaaggagattttgtttagttttttggtaggtttgaaatgatatttttaaaatgtttgttggtagttgggtatggtggtttatgtttgtaattttagtattttgagaggttaagtttgagtggattatttaggttaggagtttaagattagtttggataatatggtgtaattttgtttttattaaaaatgtaaaaattagtttggtatggtggtggatgtttgtagttttagttatttgggaggttgaggtaggagaattgtttgaatatgggaggttagattttagtgagttgagattatattattgtattttaattgggtgatagagtaagattttattttaaaaaaaaaaaaaaataaaagttagttggaatgttttttttttttttatatttttttatttttttgtttttttgtagataagttaaaaatttgttatgaggggaatggttatttttattgaggaaaggttagtattgatattatgggttggttttgtttgttttggaattttgttattgttttttagtaaatgtattatgtttatagatttgatgttttttagttgggtttggggaaatataattattgtaggtgaggtgggggtaataaggattaaaagttttttttatagttttttagaaattttgttattattttttttttttagagggttggttatagtataagagaagtgtggtttttggttgagttttttttgaggggaggaggtagggaaggttttttgggttggaatgatattttttatttttttgtgttgtgttaggaatttagataattggaggtgattttggtgttatgtgtaggtgggtttaaagttgtttgtttaagagtgtatggtgtatgattgtgtagatggtgagtattattgatttgttgatgataggtgggtggaaggggataaatttatatgtttttttattttattataggaggattgaggaggtggggggtgtttgagagggatgtttttttttatttgtttttttaagatatttttttgtttgttttttaggaaaaaagttttttttttttttagaagaattaaaattttagtgtggttaaaagattttgaggttttgttttaagattattgggggagaatttattattattgagaattagttttggtttgtggttatttataggaggtattgggggggttttgttatttatgtgtgtggaggtagttttatgagtttttgttgggtgattagtgttatatattgttttatgtatggttttgggttttttttttttgatttttttgttttattttaagtatattttttttttttttttagtaaagtgttttgttttattttttttttatttgtttttgtttatgtgtttatggttttggggataagttgtgttttgaggtttttagggagggaaggaagaagtggtatgattttatgggattaagttgtttgatgggtatttttttttatagtgattatttaaagaaggaggattatattgtttatttgggttgtttaaggtttaattttaatatgtaaggggagatgaagtttgaggtggaaaattttattttatataaggattatagtgttgatatgtttgtttattataatgatattggtgagggggaatgtttgtgattattgtggttataatggtttggggagagtgggatttagggagagattggagttgagttgaagttgttggtggggtaggggtggggtgagggattttgaagttttgatatatatgataaaggatggtagggaagagttttatgaagtttgaggggtttggtgtttttttggagagattttgaatttttttaataagtagtttttttgtgagtggaaatagttttgtgggtatatggtttgggttgggaaggttttgtttatatgaattagaaaaagatatatttttttttgtgggatgtagtttttgtttgtgttaggatatagaatttggagaatggagttttgggatggattttagtttaattattttagggggattttttagagtgtagttgggagtttttgtagaaatgatttgtatagttgtatgtagtggttttggttatttaagttttttttaatatttggaataaagtttttggggtatggggtaggggaggtttttaggtgataagtgattagtagatttttttggatgattgatttagggataggtatagttatttttttggtatttggaggggatagatggggattgtttaattagtagtgattttttttttttgattttttgtttttttttagttttgttgaagatttgttttaaggagggtaggtgtgtgtagttattttggattatatagattatttgtttgtttttgatgtataatgatttttagtttggtataagttgtgagattattggttttggaaaagagaattttagtaagtgataattgtgattgatttagaaggttttgaggagtgttttgatttgaaaatgagtttagtgtgattaagggaagattgtagagttagaggtgggagtattgaggtggtggtagatgggtttagggatggatgaagagtgttgtttagggagtgatgggttgtaaaggtaaatagatggtaggggttataggtggaggtaaatggtttagatttgtatggagagagaataatgggtttttttttgggtgatgatattttatggtgttttttttttggtgagatgttttatgtggaggtagataaattttgatgtaaatgtttttttgttttttttatttagttgattatttttatttggagtagttgaaaatgattgttgtgaagttgattttttattgggagtgttagtagttttattattatggttttgaagttattattaaaatgttgtgtgttgttgatttatagtggaaaatagatttttgttaggtgagtgttttaagtatttttttttattttttttatatttttttagagtttttgggtttgttttagttagtttaagggtgtttttttttagttaaagttttaagtagttagaattaggagtttaggtttttgagggtttaaattagtttttatgtgtttgttagatattattaaaaaaattttagttttgtgttagttattttagattgggggtatgagattttagaaagaggaaatagtaaaagataatgtaatttagtgtttagggtgtgttgtgaattataaatgattaggtgtttaggagagggaggtgagtgttaatttgagggttagggaggggaggttttaaaggaaatgtgatttgataggtatttgaagaggtagagggaagaaaggaaggtgttttagttgaaagatataaaattgagaaggaggttggtatattttgggtggggaggagaattagggtttgggagtgtggatggaatagtggtagatgatagggtttttaaagttaagtaggggattttttaattttgatgtggtagaaatggggttgtgttaggtatagtggtttatgtttgtaattttagtattgggttaggttgtagttgatggattattgaggttagagttgagattggtttggattaatatggtgaaattttgtgtttattaaaaaatgtaaaaaaaaaaattagttaggtgtggtggtgtttgtttgtaattttagttaattaggaggttgagatatggaattgtttgagtataggaggtaagtttgatgtgagttgagattatgttattgtatgttagtttgggtgatagagtgagattttgtttttttgttgaaaaaagaaagaaaatgggaagttgttaaggattttgattgggaaatttttttttttttttggtatggttgggtgatgggattagaaattttttttttatttttttagggtttattttttgtatttttggtgttatagggagatttagggggattttttgtttgttttttttaaggttgtatgattttgattggaattgtgagttggggttgtggatgtgttttgaaggataagttaggtgtttatatgagagttttatattttttattttggatttgtagttatattaaggaagagaatggtttggttttttgagggtttttagggaggaaatgggtattatttgtttttttgttggttgttatttttgtagtagagttatttttattagttgtaagaagagattgggaagataggttttgtatagatggatttgtttgtgttatttattagggtgaatgataatagttttatttttaggtataggtttgggtgttggttgtttagatttttttggttaggatggaggggtggttttgatttaatatgttattgattagtaatttgtttttttttggattgaagtttgtaggagttaaaaagggtagggtattttttgtgtatgggtgaagggagagttagtttttttgatggtgggtatttgtgaggtttatggttgagaaatgaataattttttaattaggaagtgtaatagttgaggttttttgagggagtttagttaatgtgggagtagtggtttggggagtagagatattaatgattttagggtagggttttgatattttatgaatgtattaggaaatatatatgtgtgtgtatgtttgtatatttgtgtgtgggttgtgagtgtaagtgtgagtaagagttggtgtttgattgttaagtttaaatatttttttaaattgtgtggattgtgatgttatatagagtggtttttttggagaggttataggttatttttggggttttttgggttttttatgtgatagtgtttgggaatgtatttattttgtagtatgatttgtgattagtattgttttagttttatttttatatagatgttttttttttggttagttattttttttttttagtttagtttatttaatttttattgggtggggtgaggattattttttatattgaatatttatattttattatttttatttatatttttgtaattttaaataaaagtgattaataaaatgtgatttttttgatgataaatttttttggtgtttgtatgggaaggagttggagtatataaaaaggagaaaataataaaggtgg

SEQ ID NO: 626 - DNA, 7258 bp, Artificial Sequence
  chemically treated genomic DNA (Homo sapiens)
ttatttttgttatttttttttttttatgtattttaatttttttttatataagtattagggagatttgttattagaaaaattatattttattgattatttttatttaaaattataaaaatataaataaaaatagtgaaatataaatatttagtgtaaggagtggtttttattttatttagtgaggattggatgaattaggttaaaaggaagggataattggttaagaaagggatatttatgtgaaagtgaaattgagatagtgttggttataggttatgttgtagaataagtatatttttaggtattgttatgtgggggatttaagaggttttaggagtgatttataatttttttagaaagattattttgtgtggtattatagtttatatagtttaaggaaatatttagatttaataattagatattagtttttatttatatttatatttatagtttatatataagtgtgtaaatatatatatatatatatattttttgatatatttatggaatattagagttttgttttgaagttgttagtgtttttgttttttaaattgttgtttttatattggttaagtttttttaagagattttagttgttatattttttaattgggaaattatttattttttaattatgggttttataaatgtttattgttgggggagttggttttttttttatttatgtataggagatgttttgttttttttaatttttgtaggttttagtttagaaaaagataagttgttggttagtaatatgttgagttaggattatttttttattttggttagaggggtttgggtagttagtatttaggtttatgtttgagggtaaagttattgttgtttattttggtgggtggtataggtaaatttatttgtgtagagtttatttttttagtttttttttatagttgatggagatgattttattgtaaaaatgataattagtaagaaagtgggtggtgtttgttttttttttggggatttttagagggttaggttatttttttttttggtgtgattgtggatttagggtaagaagtgtgagatttttgtgtagatgtttggtttgttttttagggtatatttatggttttagtttataattttagttaaagttatgtggttttggagggaatagatgaggggtttttttgagtttttttgtgatgttaaagatataaaagatgagttttagagaagtgaggaggggatttttgattttattatttaattatattagagagagggaagagttttttagttaaagtttttagtgattttttattttttttttttttttggtgggaggatagaattttgttttgttgtttaggttggtgtgtaatgatgtgattttagtttatgttaaatttgttttttgtgtttaagtgattttatgttttagttttttgattagttgggattataggtaggtattattatatttggttaatttttttttttgtattttttagtagatatagggttttattatgttggtttaggttggttttaattttggttttaatgatttattgattatggtttagtttaatgttgggattataggtatgagttattgtgtttgatgtagttttatttttattatattgaagttggaaaattttttgtttggttttaaaagttttgttatttgttattattttatttatatttttagattttagtttttttttttatttggaatatgttagttttttttttagttttgtattttttaattgaaatattttttttttttttttttgtttttttaaatgtttattaagttatattttttttaaagttttttttttttgatttttaggttggtatttattttttttttttgaatatttgattatttatagtttataatatattttgggtattgagttatattgttttttattgttttttttttttaggattttgtgtttttagtttgaagtgattagtgtagagttgggatttttttggtaatgtttggtaaatatataaggattggtttaaatttttaaagatttgagtttttgattttggttatttagggttttggttagagagagatatttttaagttggttggaataagtttaggagttttggggagatatggaagaggtggagagagatgtttggaatatttatttggtaggaatttgttttttattgtgggttagtagtatatagtattttggtggtgattttagagttgtagtagtggggttgttgatatttttggtgggaaattagttttataatagttatttttagttgttttggatagagatagttggttaggtggagaaaatagggaggtgtttgtattaagatttatttgtttttatgtgggatgttttgttagagaggggatattataaagtattattatttagggagaggtttattattttttttttatgtaaatttgagttatttatttttatttatagtttttattatttatttatttttgtagtttattgttttttaaataatattttttatttatttttggatttatttgttattgttttagtgtttttatttttaattttgtagtttttttttgattatattgggtttatttttaggttaaaatattttttaggattttttaagttagttgtaattgttatttattagaatttttttttttaaagttagtgattttatagtttgtgttaaattggggattgttatatattgagggtaggtagatggtttgtatagtttgggatggttgtgtatatttgttttttttggaatggatttttagtaaggttgggggaggatagagggttagaggagaaagattattattggttaggtggtttttatttgttttttttaagtgttgaggaagtagttatgtttatttttaggttagttatttagggaggtttgttggttgtttattatttggaaattttttttgttttatgttttaagggttttgttttaggtgttgaaaaaggtttggatggttagagttattgtatatagttgtataggttgtttttgtaaaaatttttagttgtattttagaggatttttttgaggtagttaggttggaatttattttaaggttttattttttaagttttatattttagtatagatagaggttgtattttataaaggaaggtgtgtttttttttaatttatataaatagggtttttttagtttaagttatatatttatagggttgtttttatttgtaagagggttatttgttggggaaatttagggtttttttagaggagtattaggttttttagattttatggaatttttttttgttattttttgttatgtatattgaggttttaaggttttttgttttatttttgttttattggtagttttaatttagttttagtttttttttgggttttattttttttaagttattatggttatagtagttgtgggtgtttttttttattaatgttgttgtggtgagtaagtgtgttagtgttgtagtttttgtgtaggatgaggttttttattttaaattttatttttttttgtgtgttggagttaagttttgagtgatttaggtagatgatgtagttttttttttttgggtaattattgtggaagaagatatttattaaatagtttagttttatgaaattatgttattttttttttttttttttagaggttttaaagtatgatttgtttttaaggttatgggtgtatggataggggtagatgagggagaaatgaggtggaatattttgttgggaaggagaaagggatgtgtttggggtggggtagaagagttgaagaggagaaatttagggttgtatatgaagtagtgtgtggtgttgattatttagtaagggtttatgaggttgtttttatatatgtaggtgatagagtttttttggtgttttttgtagatggttgtaaattagggttggtttttgatggtggtgaatttttttttaataattttaaagtggggttttagagttttttggttatattgaaattttaatttttttggaggagaggagggttttttttttggaggataaatagagggatgttttagggaggtaggtaggagaaagtattttttttgggtattttttatttttttagtttttttgtgatggaataaggggatatgtaagtttgtttttttttatttatttgttattagtaggttagtgatgtttattatttgtgtagttatgtattatgtatttttggataagtggttttaggtttatttgtatatagtattagggttgtttttggttgtttgggtttttggtataatatagaaagataggggatgttattttaatttagagggttttttttgttttttttttttagggaagatttaattagaggttgtattttttttgtgttatggttagttttttgggagaaggggatggtaataaggtttttgggaagttgtagggagggtttttggtttttgttgtttttattttatttgtagtaattatgtttttttaggtttagttgaagagtattagatttgtgggtatggtatgtttgttgaaggatagtggtagagttttagggtaggtagggttggtttatggtgttagtgttggtttttttttggtaaaagtgattattttttttatagtaggtttttgatttatttataaggggataggaggatgagagaatatgagaaagagaagaatattttaattaatttttatttttttttttttttgagatggagttttgttttgttgtttagttggagtgtagtggtgtgattttagtttattgagatttggttttttatgtttaagtaatttttttgttttagttttttaagtagttgggattataggtatttattattatgttaggttgatttttgtatttttagtagaggtagggttatattatgttgtttaggttggttttgaatttttgatttaaatgatttatttaaatttgattttttaaaatgttgggattataagtgtgagttattatgtttggttgttaatggatattttaaagatgttgttttagatttgttagaagattggatagggtttttttttaattttattttatatttgtgtggttattgttttgtgagtgtgtgtgtgtgtttatgtttgttatatagggatgaagatgttatttattttatttttagtttttaatttttgtttgtttttgttttttatttatttttttttgtttttaaattttttttttagttgtagtggagatttttatatttattttatagtgttgttttttgaatttttttgggtagttgtattagtgaatgttggagaagtatttgttggatatatatgtttttttatttagatagttatagtttgttggagagaataaaggtggggtaagtgagggggagtggaagtggtaaggggtggtgtatgttgtagtagagggtagggaggggagtgttttttgaagtttttttaatttgtttgtgtagttaattgttgtaggggtggatatttatatggaatttgatgaagtttattgttgttttggaagagatttgggaggaggttttattaaaggttttatgttttagggatttagggtgagggtaaattggttttaattttaaaatttattttttttttttttttttgttttattttgtttgtatttagtttttaaatggaagattatggtttttagttaggagaaatggattaagttttatttattagatgtttgtaggttggggtagttttggtggtttttttttttttttgttagttagtgttaatttttgtggtttttaagtttttgttgttattttgttttattttttggggagagtttggttttgttgtggatggaatttggagattttagttttttgagtagtttttttttttttttggtgttgattagaggtttttgggtagtattagttaaagtaagagtgtatttattttggagttgtttatgattaggatgtagagaagtaggtgtgttagtagggtttttatggtggtgaggttggggtgttagatggtggttttgtaaaggaaggagaagttagggtaagaggtggaggaatgggaaggtaggttaggtgggtgattgtagtgtaggggagatgtttgtggtgattaggttttttagttgttttttttttttatgggttttggattttgggtagtttggattggtatttgtgggggatgtttgggatggggtgttttgattttgtgtagttgttggggagtttagggagtttgggtagtttagggtggggtaggtagatgtttgggagttggggttgttgtgtatttggtttggggattttaggattgtggtatttattggtggttgtggtaggagggtgtgagttggtgttgtggggataggtggattttggtttgggttttgggttgtggtttttgattgtgttgtgatttgtggtgtttgttttatattagggtttgttttggtgttgttttttttttttttgtttggtttttttttttgttttgtagtgtttagtgatttggattttgtgtgtttttgtaatgtttataaagatttgggggaagtgtgatttttagtggaggggatttaatagtgtttggattgaggaattgagaggtttgtaaattttttgtgtttttttttatgtatttgttggggtttgttttagtgtaaggagtttttgaattgtagagaggagagaaggtgtataggagattttttattttagtttagttttgaagttttttgggttttttaattagtttttttgtaattttttttgttgggttttaatttgtttaagattgttttagatttttttgttgtagttggatggagttgtgagtttggttgttggatggagttgtgaagtttttattatgtgataaatgtatgagatatatttttttaagaagtatagatagaaaaatttttgtttgtaggggttttttttgtgtgtttgtttagtggtagtttttagatattattaatataattagtggatggaataaagttgggtttattgtttttggtagtaagggggtttgtttgatggtgttattagagggggaaaggtaaggttagattattgaaaatttgtagtttggtttaaagtttgtttttgatagggtttgataaggattgggttaggtgttgtgatatgatgttataggattgtgggaataaagttttagggtataaattgttggtgttttttattgaa

SEQ ID NO: 627 - DNA, 4930 bp, Artificial Sequence
  chemically treated genomic DNA (Homo sapiens)
aagttgattttttgatgtttttaatgtttggtttaattgatttgttttaatggagtttttgttggtgaggagtgagatgttattgattagaatgttgggatttgttgtttaattgttaggagtgagagatattgagatttagaaatttttggaggtgggaggggagagggatagttttggatggaggtggagatgtaagataaagggatggattttatataggaaaaaaaaaaagattttgttgaggtattgaggtgttgtatgattatattttttaaaggagaagttaaaaagtaaggaagtgggaggaggttggaggttaaagtatttaaaaggattatttgggtataatttgtttttttgttggtgtttgtaaaggatagatagttttgtttttaaagtatatgaatgttttttttaagtgattgggaatggatattaattgtttgttaaatgttattaaatgtttttttaaatttaggggatatagaaagaggggtataaaaggagaatttaaatagaaaaagggaggatttggaggtttttgaaagtggggggagaagaaggaggagggataatagagaggaatagagaaggagagtggagagaagataaataaaaataaaaataggaattattgaataattatatattaaaaagaaagtttttttttatggggtatttaaaatattgagattgtaatagtgattttggttatggaagaaagatgtttttttttatttttgtttttgaaagtttttggttttgttattggtgattaaaattttattaggttaaagagtgtgtttaattgtttgaagaatgtagtagatggaaggtgggttttgttatgttgtttgttttttttgttggagagaatgaaagaaatgtgtagagttagagatttttgttgagttagatttttttttgttgttttaggttattggttatttggtaaagatttgagtaaggaatgtagggttattgtttgggttaataaatggagtttgtttttttttttttggatgttgttgtttggttgatgtttttggtaatttatttgtggtgtatgtagaggagttttttttttttttttagattatttgttttgattaatttgattttttaaatatatttgattgtattttttaggtggatatattaataggttatgggttggagaggagtgggtgatgaggagagggatttaaatttgtgaatgtttgggttgggttggagttgtggggggtttgggaggagagaggggagaagagagaaggaaggagagtgtttgttgggatggttgagttgttttggtgagtagttttggggttgtatgtttttgtgggagatgttgttgttgtttttaggttggtaagagtggttttaatattattgttttttatttttttttttgtaaatttttagagaaatgtttttggtttttttgttgtgatatttttagtttgtatttttttatagtttaggtggtgtgtttttgtatgttggagtgttggttgttagtaggatgtttttttttgtgttgatttgtttttttttgttttgttgttgttgtttttttgatatttttgtttttattatttttagtttggagagatgttatttagttgtggtttgtatttgtggtttggggttatgtgtggaagaggggtgttagtttggattttgtttttggtagggggtgttttggagtggagagtgaggtgaatggtatatgagtgtgtgggtagtttattttgaagtttgagttttttatttgagttatttttgtttagttttatttgggttagtgtttggtgagtgagtttatttgtggtttttgtggttgttttttttttgtatttttgtatttttttgttgattttttttttttgggatttgtattttgttttattaattagagtttgattgtttttttttatgtgattttgggtgggttgaggatttgttgttttttaaatgttagagggatgtgggtggtagagtttgagaggtggttgttgggttgtggggtgttttgattttttttttattttgtttttttgggttttatttgtttgtttttggatttttgtttttttttgttttttggttttttagagttttttttttatggtagtagttttttgtgtttttggtgtagttttttagtggatgatttttttgttttggggttgagtttagtttttggatgttgttgaaatttttgagattatgtgtgggtttggttgttgtttttttgttgggtgttattgttattgttgttgtttttgttgttgttgtttgtgggatgtttagtagtttgttgtttggtttttgtgattttgtgttttttggaagttgtttgttgttgtagagttgtatgaattagttatggtgttgtgggagtttttgtggtagtgtagtagttggatattttgtgagggtttttgttggttgttgttgttgtttgttatgttatttattgtagtttgtttggtgaagtttgttgttttttttatttttttaagtgattgttaaatgtttattggttggaattgttttggtaagtttagaatttttgtttttgattttttaattttgtagaagaatatgtgtatttagtatagattagtttattttagtgtgtttttttagttttttattttttattgttttagatttttaatattatttatttttatttagagaaataaggggaattgttgtaggtttgggggtgaggggtggttttgggatgggtagaaagtgtaggtgtagtaggaaatttttgtatgtttgtgtttatattggagttgtgaggattttgagaaatattaaatgggatggttttttgggtttattgttttgaaagagtattaattttaggggaaatattgaaatagaagttttgttattattaaagaaaaaagttttattaggatgaggaagaaataattttatgagaaagaatgagtgagaaagtaataaattaaatggtgattgtaggggaattgttgatttttggtaaaggtgttatgaggttgtattggttttttgttgaagattaggttatatagattttagaggagttgggttttaatagaatttttttttttttttttttttttttttttttttttttttttttttttttatttatttattttttttttttttttattttttttttttttaggtggtaaaagatattggttttgtagtttagatatgtttttttttttgtttttttaagttttaaggtagtataggggagttgagaaaaagaatattttgtgggttttttaggttggagtgggtatgattgaggttggttaggttttatgtaggtgagttgagggtggaattgattttagtgggtgttgatttttttatttttggataggtttttgtggagtgggttaggtattttttttgtttgtttgggtttttttagattttgatggtgaatgtttggtaggttttgttttgttgaagttttttaattaaatagggttagaggatgggagttgttgtatttttagttggtatagtattttggtttgatagtttgtagtatattgggtagaattgtggtgtaatttttttggtattttaaattttgttaatatgtttgggtattgttttttaggtgtggtttgttttagttttagtaagtgtgtatgtaattttttattttttgtgaatataattttgttgtagttaaatttggttttgaataaagtgttttttaaagatgtatataagttgaagtgtatgtaattttagagaggagggaatgattaattgtaatttagggtgaaagtttgtatagtttttagttattattgatgtaaatgttaaaaggaaaattattatgtattattttaatttattttttataaagataagttgagatatgtaattttattagatttgggttaatagattgtttttttttttggtagtttttaaatttggtattttaataaaatttaatatgtttttataattttttgatttatgtgtatatgtgtgttgtttttgaaagaataagttttattttgttattgtttaattattttttagatgttttattatggtaataattatgagtttgtaaaaataatttttggaaatgttgatggttttgtagtttaatatagattggtttgttttatttttagtttttgtattgttttaggaaataattaatttaaatgtgaagttgatatttgtaattaagaaattatatatttattagatattttaaaggggattgtataaattaaagagaataaattggttttgtagataggttgttaagaatttggtattttgtttttatttttgttaatttagaggtgattaatttttatttgagttaaatagattattatagaaaatattgtgtttgtttatttttattattgaggttttgttttttttttgtttggatatattttaaataaggggttgttttagttgttgaagtaaaagaataattaaagatggggaaatggtaaaagggtatttagagattattattagtttttttttaaaatgtggagttttgtggttataaatattgtttatttaatgagtaaaaaataaaaataaaaaaaaaataggaagtaaatgttaagtttttatttattattgttagtattaatgtaagttttaaaaaatagtattattagaaaaggatattaaaggagaattgattagaaaagaattgtggaaaatggaaatgaatattgattatttaattagattttgaggttattagtagatagtgattttgtagtatagttatagttgttggatttaaaatttaggataagtattttaaagttttaaagtagtgtttttttttgttaaaaatttgtaagatgttttaatgattggagtgttttttttgaatttgagg

SEQ ID NO: 628 - DNA, 4930 bp, Artificial Sequence
  chemically treated genomic DNA (Homo sapiens)
ttttaaatttaaagagaatattttagttattaaaatattttatagatttttaataaaaaaaagtattattttgaagttttaaaatatttgttttaaattttaaatttaataattatagttgtattgtaaggttattgtttattgataattttaaaatttagttaagtgattaatatttgtttttattttttataatttttttttagttaatttttttttagtatttttttttgatagtgttattttttaaagtttgtgttaatattgatagtggtgaatgaaagtttaatatttgttttttgttttttttttatttttattttttgtttattaggtggataatatttatgattataaaattttatattttggaaaagagttagtgatgatttttgaatatttttttattatttttttatttttaattgtttttttgttttaatgattgaaataattttttatttgaaatgtatttagataaagaggaaataaagttttaataataaagataaataggtatagtgttttttgtgatggtttgtttggtttaaatgaagattgattatttttaagttaataggggtggaagtggggtgttaagtttttgataatttatttgtaaaattagtttattttttttagtttatgtagttttttttaaaatatttggtaaatatgtaattttttgattgtaaatgttaattttatatttaagttagttattttttaaaataatgtaagggttaggaatgaagtaaattagtttgtgttggattataaagttattaatatttttaaaaattgtttttgtaggtttataattattattataataaagtatttaaaaagtgattaggtaatagtaaagtgaaatttatttttttaaaaataatatatatgtatgtatgaattaagaagttatagaaatatgttgagttttattaaaatgttaaatttagaaattgttaaaaaagagaataatttattgatttaaatttaatagggttgtatattttaatttgtttttgtaaaggataaattagaatgatgtataataattttttttttggtatttatattagtaataattaggaattatataggtttttattttgagttatagttggttatttttttttttttaaagttatatatattttagtttatatatatttttgaaagatattttatttagagttagatttaattatagtaaaattatatttatagaagatgaaaaattatatatatatttgttaaaattagaatagattatatttaggggataatatttaggtatgttaatggagtttaaaatgttaaggaaattatattataattttgtttagtatattataggttgttaaattgaaatgttatgttagttaggagtgtagtaatttttattttttggttttatttaattaggaagttttagtagagtgaagtttgttaagtgtttgttgttagaatttgaaggaatttgagtgagtaagaagagtgtttgatttattttatagaagtttgtttagaaatggaggagttagtgtttattgaagttggttttgtttttggtttgtttatatggagtttgattagttttagttatgtttattttggtttgggagatttgtaaagtgtttttttttttaatttttttgtattattttgaagtttagggaagtaaagagaggggtatatttggattgtaaaattaatgttttttgttgtttaggagagaagggaatgagagagagagagagatagatagatagagagagagagagagagagagagagagagagagagagagagagagaaattttattgaaatttagtttttttagaatttgtgtgatttggtttttaatgggagattagtgtgattttatggtatttttgttaggaattagtgatttttttgtagttattatttgatttattgtttttttgtttatttttttttataaagttattttttttttattttagtaagatttttttttttaatgatgataaagtttttgttttagtgttttttttaggattggtgtttttttaaaatagtgaatttagaaaattattttgtttaatattttttaaaatttttgtagttttaatgtaagtgtaagtatgtaaaggttttttgttatatttgtattttttgtttattttagaattattttttatttttgggtttgtaatagttttttttgtttttttggatagaggtgggtggtattaggggtttagggtagtaggaggtgaggggttgaggaggtgtgttagggtaggttggtttgtgttggatatgtgtgtttttttgtggagttaaagggttggggatgggggttttggatttattagagtaattttagttggtgggtgtttggtagttatttaaggaggtagggaaagtagtgagttttattgggtgggttatgatgagtagtatgatgggtagtagtagtagttagtaaaagtttttgtaaagtgtttagttgttgtattgttgtggggatttttatagtattatgattagtttgtgtaattttgtagtagtaaatggtttttgaggaatataggattgtgggggttgggtagtgggttattgagtattttgtggatggtggtagtagaggtggtggtggtggtagtggtatttggtggggaagtagtagttaaatttgtgtatgattttgagagttttagtaatatttagggattgggtttagttttggagtgagagggttgtttgttgagaagttgtgttggagatgtgggaagttgttgttataaggagggagttttgggaagttggaggataggaggagatgggagtttaggggtagatgagtggagtttgaggaggtagggtggagggagagttaaggtgttttgtagtttggtagttgttttttgagttttgttgtttgtatttttttggtgtttgggaagtagtaggtttttagtttgtttggggttatgtgggaagaggtagttgggttttgattggtggagtaggatgtaggttttgggagggaggggttgatgaggaggtgtaaggatgtaaggaggaggtggttgtggaagttatagatgggtttgtttgttaggtgttggtttgagtggggttaggtggggatggtttaaatgagaagtttgggttttagggtgggttatttgtatatttatatattatttgttttattttttgttttaggatgttttttattgaaggtggggtttggattagtgttttttttttgtgtgtgattttgggttgtgagtgtgggttgtggttgggtggtgtttttttgagttggagatggtgggggtggaggtgttagaggagtagtagtagtagggtagagaggggtgagttggtgtgggagagggtgttttgttggtgattggtgttttagtgtgtgggagtgtgttgtttaggttgtagggggatgtaggttgggaatgttgtggtggagaggttagggatgtttttttagggatttataggaaagagggtgagaggtgatggtgttagaattgtttttgttgatttggaagtaatagtagtattttttataagagtgtgtaattttaaggttgtttgttgaggtagtttagttattttggtaggtgttttttttttttttttttttttttttttttttttttaggttttttgtagttttgatttagtttaagtgtttgtaggtttgaatttttttttttattatttgtttttttttagtttgtagtttattagtgtgtttatttgggaggtgtggttagatgtgtttggaaggttagattggttgggataagtggtttgagagaaagagaaaggtttttttgtatatgttgtgggtgggttgttgggagtattggttgggtagtggtgtttgggaaggggagagtgggttttatttgttggtttaggtagtgattttgtgttttttatttgggtttttgttggatggttggtgatttggggtgatgagagaaggtttaatttggtaggagtttttggttttgtgtgttttttttattttttttagtgggaagggtaaatggtatagtgggatttgttttttgtttgttgtattttttaggtagttagatatattttttagtttaatggaattttagttgttagtaatgggattaagagtttttggggataagggtggagaggaatattttttttttatgattggggttattattgtagttttagtgttttggatgttttatagggaagagttttttttttggtgtgtgattatttagtgatttttgtttttgtttttgtttattttttttttgttttttttttttatttttttttgttatttttttttttttttttttttttgtttttaaaagtttttggattttttttttttttatttaaattttttttttgtgtttttttttttgtgttttttgaatttaggagagtatttgataatatttaataggtaattagtgtttatttttaattatttaaaagaggtatttatatattttgaaaatgggattatttattttttgtagatattagtagaaaaataaattgtatttgagtaatttttttaagtattttaatttttaatttttttttatttttttgttttttaattttttttttgagagatgtgattgtgtagtattttagtgttttaatgaaattttttttttttttttgtgtgaaatttatttttttattttatatttttgtttttgtttgagattgtttttttttttttttatttttaaagatttttgaattttagtgttttttatttttggtaattaagtagtagattttagtattttagttggtggtattttgttttttattgatgaagattttattaaaatagattaattagattagatgttggaggtattagaaaattggttt

SEQ ID NO: 629 - DNA, 2501 bp, Artificial Sequence
  chemically treated genomic DNA (Homo sapiens)
gtaaatttttatattttgaggagagatagggttttattatgttggttaggttggttttaaatttttgattttaggtgatttatttgttttggttttttaaagtgttgggattataggtgtgagttattaagtttgatgggtagtaatttattttttatataattttttttttttttttttggtagagatgaggttttgttatgttgtttaggttggtttaaaattattgggtttaagtgatttgtttatttgggttttttaaagtgtagggattataagtatgaattattatgtttggttgtaattttttatatattttggatattaattttttattagataatatagtttgtaaattttttttttttttattttgtaggttgtttttttattgttggttattttttttgttgtatagttatttttaagtttgttgtaaatttatttgtttattttttgttttgttgtttgtgttttgttgttatatttaagaaattattgttaaatttattgttatgaagtttttttttatgtttttttttaggagtattatagttttaggttttatgtttaatttttaataagttttgtgtttttgtatatggtgtaaggtaagggtttaattttatttttttgtatgtggttatatagtttttttagtattatttgttaaagatataattttttttttatgttttggtgttttaaaaaaaaaaaaaattttggttggttatggtggtttaggtttataattttagtattttgggaggttgaggtaagtggattgtttgaggttaggagttttagattagtttggttaatatggtgaaattttgtttttattattgaagatataaaaattagttaggtgtggtggagtatgtttgtaattttagtttattagggaggttgaggtatgagaattgtttgaatttgggaggtagaggttgtagtgagttaagattttattattgtatgttagttggggtgatagagtgaggtagggttttattttgttgtttaggtaggagtttagtggtttaattatggtttattgtagtttatattgttagggtttaagttatttttttattttagttttttaagtagttaggattataggtgtgtgttattatgtttagtaaatttttgtattttttgtagagatggggtatttttatgttgtttaggttggttttgaatttttaattttaagtgatttttttatttgggttttttaaagtattgggattataggtgtgagttattgtgtttgatatggtgttttttaatttatttttattttttatttttatttttttgagataaggttttgttttgttttttaggttggaatgtagtggtataattatggtttattgtaatttttgtttttttggtttaagtgatttttttgttttaatttttggagtagtttggattatgggtatatgttataatgattagttaatttttgtttttttttttttttttttttttttttttttttttttttttttttgagatgtagtttttttatgttatttaggttggtttaaaatttttgggtttaagtgatttttttattttggttttttaaagtgttgggatgataggtgtgagttatgtggtgtttaaaaaaggtaataaaaaattttttatatattgggtatagaagtggtatgggtttttatatattgtgagatttttggtattagttataaattttgtgtatatttaagattttttagagtaggtgtaattattttgttttatagatgaggatatagaggttgagttgtagtgatttatttaaggttgtatagttagtaaatagatggaggttggattggaattgaggattttatttaagggtttttataaatttttgggggttttttgttgttttatttttattatatttgaaagaatgaatgaatgaatgttttgggtattgtgtttattttttagtaaattgtggagtttggatgagtttattgttttgtgtggggggggtgtgtgtttgttttgtgtatgtgtgttttttgggtatggttggttttgttttatttttttgtatagggtattgtttttttttgtttggtatattttttttttttttatgtttggattggggtggtagatgttgtttttgtttattgtttttttttattggtttttgtgtgaaaagttggggtgtttgtgttgttgttgttgtgtttgttgaagtttttgagatgttggtgtgtattgttttagtttgggtgtttatattggttgttttggttattttgttgtttgatgatgtttgtaggtggtaggtattatgggggggaatatggatttagggggataggtagggtgttgggtggggggttgtttttttttggggtggttggtggttgttgttgatagatgggtgtgtatgtgtggggtggtgtggtgtgtagtggtagttggtgtgggtagggtggtatttttggttgtgtgtgtttgggttg

SEQ ID NO: 630 - DNA, 2501 bp, Artificial Sequence
  chemically treated genomic DNA (Homo sapiens)
tagtttgggtatgtgtgattggaagtgttattttgtttgtgttaattgttgttgtgtgttgtattattttatgtatgtgtgtttgtttgttagtagtggttattggttattttgaggggaagtgattttttatttagtgttttgtttgtttttttgagtttgtgtttttttttatggtatttattgtttgtggatattgttgggtagtgagatggttgggatggttagtgtgggtatttgggttggggtggtatgtgttggtattttggaggttttagtagatgtggtggtggtagtgtaggtgttttggttttttgtgtggaaattgatggggaggggtgatgagtggaggtggtgtttattattttagtttgggtgtgggggaggaggggatgtattaaatggagagaggtgatattttgtgtagaaggatggaatggagttggttatgtttagggaatatgtatgtgtaaggtgggtatatattttttttatgtggagtagtgggtttgtttaagttttatggtttgttgggaggtgggtatggtgtttgaggtatttatttatttatttttttaggtgtgatggggataaagtagtgagaagtttttaagggtttgtgagagtttttgagtaaagtttttagttttaatttaatttttatttatttgttggttatatgattttaggtgggttattatggtttagtttttgtgtttttatttgtaaaatggggtaattgtatttattttagaaaattttgagtatatatagaatttgtagttagtattaagaattttatagtgtatagaggtttatgttatttttatatttagtgtgtggggggttttttgttgttttttttaagtattatgtggtttatgtttgttattttagtattttgggaggttagggtgggaggattgtttgagtttaggagttttagattagtttaggtaatatagagaaattgtattttaaaaaaaaaaaaaaagaaagaaagaaagaaagaaaaaaagaaaaataaaaattagttagttgttgtggtatgtgtttatagtttaaattattttagaggttgaggtaggaagattatttgaattggagaggtagaggttgtagtgagttatgattgtattattatattttagtttgggagatagagtaagattttgttttaaaaaaataaaaataaaaagtaagaataaattaagaagtattatgttaggtgtagtggtttatgtttgtaattttagtgttttgagaggtttaggtgggaggattgtttgaggttaggagtttaagattagtttgagtaatatagggatattttatttttataaaaaatataaagatttgttgggtatggtgatatatatttgtaattttagttatttgggaggttgaggtgggaggatggtttgaattttggtagtgtaggttgtaatgagttatgattgggttattggatttttgtttgggtgatagggtaagattttgttttattttgttattttggttggtgtgtagtggtgagattttggtttattgtaatttttgttttttaggtttaagtgatttttatgttttagtttttttagtaggttgggattataggtgtattttattatgtttggttaatttttgtatttttggtggtagagatagggttttattatgttggttaggttagtttgggatttttagttttaagtagtttatttgttttagttttttaaagtgttgggattataggtttaagttattgtaattagttagaattttttttttttttaaagtattagaatatgggggaaagattgtgtttttaataaatggtgttgagaaaattgtataattatatataaaagaatgaagttggatttttattttatattatatataaaaatataaaatttattaaagattaaatataagatttgaaattatagtgtttttagaagaaaatatggggaaaagttttatgataatggatttggtaatgattttttggatatgatagtaaaatataggtaataagataaaagatagataaatgggtttgtaataaatttaaggatagttatatagtaaaagaaatgattaatagtgaaaaggtaatttatagaatggggaaaaaaaaagtttgtaaattgtattatttggtaaagggttaatatttggaatatatgaaaaattatagttaggtatggtggtttatgtttgtgatttttgtattttgggaggtttgggtaggtagattatttgagtttggtagttttagattagtttgagtaatatggtaaaattttgtttttattaaaaaaagaagaaaaaaattatataaaaaataaattattatttgttaggtttggtggtttatgtttgtaattttagtattttgagaggttaaggtgggtggattatttgaggttaagagtttgagattagtttggttaatatggtgaaattttgtttttttttaaaatataaaaatttgt

SEQ ID NO: 631 - DNA, 3814 bp, Artificial Sequence
  chemically treated genomic DNA (Homo sapiens)
ttttttattttttattgttatttatttagtgttgtgtagtagtttagttgtgtgtttgttgggaggggttgttaagtgttttgtttattggttgttttttgaatttttgttattttatgtataaatatatttatatattttttttgtttagtttatatattgagttatttgtatatgtgagtatatttttttttttttttttatttttttggtttttgatttttataagtttatggaatatttttggaaagatgtttttgatttagtagggtaggtttgttttgatttttttttttgtagttttagtattttgagaaagtaatttatttttttggttagtgtttgtattttagtagggagatgaggattgttgttttttatgggggtatgtgtgtgtttttttttttttttaggatttgtaggattttttgtgttatttgtatataatttggtaggtttatattttttaagagttttatgaagtgttttttgtatgtgttttaaaaaggtatttgaaaattgaaagtgtgatttatggaaattaaattatttgtaaaaaattgttttggaaagtaatgattgttggttataaagggaaatatttgtgatgtatttaatgtgtttttaattttttatttgttgataatttatagttattaatgttaaatttgattttggttttagttatatttgtatattgtttaataatggtttatttttgtaagaattagataaaatgtatatttgatataaaatagttaaaaatgtaatttttagtaatagtaagtttggtatttagatagattatgaatattttgttagatattttgttgggtgtttgggatagtaattaaaataaagtattgatagttgtattagagtttattaggttgtagtaaaggaagtttatttaaaagtataaattatttaagattatagatgtatgatatattttatttattttttgtttttttaatatgtatatatatatatatatatatatatatatatatatatgtgtgtgtgtatgtgtgtgtgtatgtttaatttttaatttagttaaaaatttttttttatttgttttttatttggatatttgattttgtatattttagtttaagtgaattgagaagattgagttgtaggattaaaggatagatatgtagaaatgtattttaaaaatttgttagttggattagattgataatgtaatataattgttaaagttttggtttgtgatttgaggttatgtttggtatgaaaaggttatattttatatttagttttttgaagttttggttgtataattaatttgtggaaggtatgaatatttatgtgtgttttaattaaaggtttttttgaattattttttatatgagaatttttaatgggattaagtatagtattgtggtttaatataaatatataagttaggttgagagaattttagaaggttgtggaagggtttatttattttgggagtattttgtagaggaagaaattgaggttttggtaggttgtatttttttgatggtaaaatgtagttttttttatatgtatattttgaatttttgtttttttttttttagatgttttttgttagtttttttagttgttaaatatagttgtttgtggttggttgtgtatgtaattgtatattttattttatttgttttattttggttatagtgtagttttttttagggttattttatgtatatattatgtatttttagttaatgaggagggggaattaaatagaaagagagataaatagagatatattggagtttggtatggggtatataaggtagtatattagagaaagttggtttttggatttgttttttgtgtttattttaagtttagttttttttgggttatttttagtagatttttgtgtgtttttgttttttggttgtgaaatttagtttttatttagtagtgatgataagtaaagtaaagtttagggaagttgttttttgggattgttttaaattgagttgtgtttggagtgatgtttaagttaatgttagggtaaggtaatagtttttggttgttttttagtatttttgtaatgtatatgagtttgggagattagtatttaaagttggaggtttgggagtttaggagttggtggagggtgtttgttttgggattgtatttgtttttgttgggttgtttggttttattggatttgtaggtttttggggtagggttggggttagagtttgtgtgttggtgggatatgtgttgtgttgtttttaattttgggttgtgttttttttttaggtggtttgttggtttttgagttttttgttttgtggggatatggtttgtattttgtttgtggttatggattatgattatgattttttatattaaagtatttgggatggttttattgtattagatttaagggaatgagttggagtttttgaattgtttgtagtttaagatttttttggagtggtttttgggtgaggtgtatttggatagtagtaagtttgttgtgtataattattttgagggtgttgtttatgagtttaatgttgtggttgttgttaatgtgtaggtttatggttagattggttttttttatggttttgggtttgaggttgtggtgtttggttttaatggtttggggggtttttttttatttaatagtgtgtttttgagtttgttgatgttattgtatttgttgttgtagttgttgttttttttgtagttttatggttagtaggtgttttattatttggagaatgagtttagtggttatatggtgtgtgaggttggtttgttggtattttataggtatttgtgtttgtgttgtttgttggggtggttgttgtgtttggtaggagggagggagggagggagggagaagggagagtttagggagttgtgggagttgtgggatgtgtgatttgagggtgtgtgtagggagtttggggtgtgtggtttagtttgggggttttgtgtgtagtttgtgttgtgtttagagttaagtttttttgttgggtagttgaaaaaaatgtattttttatttatttattgtttgtgtgagaggtagatttgaaagtttgggttttttaataaaatatatgttggaaaattagataaagtagtagttatttgtgggggaaaatatttttaggtaaataaatatggggtgttttgagttatttgggaaggttttgtttttggtatttaaagttgggggtgtttggagttagtagagtttagtagagttttatttatttttttaatgtttttgtttaatgtgttttttaaatttttttttatttagattatttgattggaaatatgttagttatgatgatgattttttgggaagtgatttttgttatttgttttttttttttttttattttatgttttggggttttagagagtgattgggagttgaatgggtttgattttggagttagttggttgagtttgtgttggagtggattgttggtatgtgatttttgatagttggaaatttgtaggtgttttgtgagtttaaaataagttatatggaagtataagtgtttaaaaataattttttgttagtttagtgataagtttgttttatttggggagaatgttttggagtggtgtgtgggttagttagggtttgtgttttgtagttattgtggaaggagtgtggttggtttaggatataggagattattttgtgattttaatggtgaaggttgtgtgtttttattttaatttttttttttataagaattgttttttttttttttttttttttttttatttttttttgtttagtttttttttt

SEQ ID NO: 632 - DNA, 3814 bp, Artificial Sequence
  chemically treated genomic DNA (Homo sapiens)
aaaggagaaattgggtaagagaaaatgggagggagaggagagggagaaagaataatttttgtagggaaaaaaattaaaatgaggatatataatttttgttattgaagttataaagtggttttttgtgttttggattggttgtgttttttttatagtggttgtgaggtgtagattttggttgatttgtatgttattttggggtattttttttgggtgggataggtttgttattgggttggtaggagattatttttaagtatttgtgtttttatatggtttgttttaaatttgtgggatatttataaatttttggttgttagaagttatatgttagtaatttgttttagtgtggatttagttagttaattttgaaattagatttatttaatttttaattgttttttaaagttttaggatgtggggtggggaggaggggaaagtgggtgataggaattgttttttagaaagttattattatagttgatatatttttaattaaatagtttagatgaaaggaaatttggggagtatattaaataaaaatattaaaaggataaataaaattttgttgagttttgttaattttaaatatttttaattttaaatgttaagagtgagatttttttaagtgatttaaagtgttttgtgtttatttgtttggaggtgtttttttttataaataattgttgttttgtttggttttttaatgtgtgttttgttaggaagtttgggtttttgggtttgttttttgtatggatggtaagtgggtggagagtatgttttttttagttgtttggtgagagaatttgattttgaatgtagtgtgggttgtatgtagaatttttgggttgggttgtgtgttttgggttttttgtgtgtatttttgggttgtgtgttttgtggtttttgtagttttttaggttttttttttttttttttttttttttttttttttgttgggtgtggtggttattttgatgggtggtgtgggtgtgggtatttgtagaatgttggtgggttggttttgtgtattgtgtagttgttgggtttgttttttaggtagtagggtatttgttggttgtggggttgtaggaaaggtgatagttgtggtggtgggtgtagtagtattagtgggtttggagatatgttgttgagtggggggaaattttttaggttgttggagttgaatgttgtagttttagatttggggttgtaggggaggttggtttgattgtagatttgtgtgttggtggtggttgtggtgttgaatttgtaggtggtgtttttggggtagttgtatatggtgggtttgttgttgtttaggtatattttgtttaggggttgttttagggggattttgagttgtggatggtttaggggttttagtttgtttttttggatttgatgtagtagggttattttagatgttttggtgtggagggttatggttatggtttgtggttgtgggtagggtgtagattgtgtttttgtagggtagaaggtttagaaattggtgggttatttggaaaaagagtatagtttgaggttagaggtgatgtagtgtatgttttgttgatatgtgagttttggttttggttttgttttgggagtttgtgggtttggtgaagttgggtgatttgatgggagtaagtgtagttttaggatgaatgttttttgttagtttttgggtttttgggtttttaattttaagtattggttttttgagtttatatgtattataaaggtgttggaggatggttagggattgttgttttgttttgatattggtttaaatattattttaggtataatttgatttggagtgattttaaagagtagtttttttgaattttattttatttgttgttgttgttggatagaggttgagttttatggttagggggtgggggtgtatgaggatttgttaaaggtggtttagggaagattgggtttaaaataaatgtgaaagatggatttaggggttggttttttttaatgtgttgttttatgtgttttgtgttagattttgatatatttttgtttgtttttttttttgtttgattttttttttttgttggttagaaatatgtagtgtgtatataggatgattttggggaggattatattgtaattgagatagggtagatagaatggggtgtgtggttgtatatgtagttagttatagatagttatatttagtagttgggggaattgatagggggtatttgaggggaagggggtggagatttagggtatatatataggaagagttgtattttgttattaggagaatgtaatttgttaggattttagtttttttttttgtaaaatgtttttaaagtagatagatttttttataattttttgagatttttttagtttgatttgtgtgtttatgttggattatagtattgtatttggttttattaggaatttttatgtgaaggatgatttagaaaaatttttggttagggtgtatatgggtgtttatgttttttataggttggttatgtaattaaaattttagaaaattgaatataaaatgtgatttttttatattaaatataattttaggttatgaattaaagttttggtaattatgttatattgttggtttggtttagttaatagatttttaaaatgtatttttgtatgtttattttttagttttataatttgatttttttggtttatttgggttaggatatgtagaattaaatatttagatgaaaaataaatagaaaaaagtttttaattgaattaaaagttaaatatgtatatgtatatatatatatatatatatgtgtatatatatatatatatatatatatatatatattaaggagataaaaaataggtgaagtatattatgtgtttataattttggatagtttatatttttgaataaattttttttgttgtagtttaatagattttgatataattattaatattttgttttaattgttattttaaatatttaatagagtatttgatgaagtgtttatggtttatttaaatgttaagtttattgttattaagagttatatttttgattattttatattaagtatatattttatttaatttttataaaaatagattattgttggataatatgtaaatgtagttgaagttaaaattgagtttagtattaatgattatagattgttagtaaataaagggttaaaaatatattaggtgtattgtagatatttttttttatggttagtaattattattttttaaagtaattttttatagatgatttaatttttataaattatatttttaatttttaaatgtttttttaaaatatatgtaaaaagtattttatagggtttttaaaaaatgtgaatttgttaaattatatgtaaatggtataaagaattttataagttttgaaagaaaaaggagatatatatatatttttatggagaatagtaatttttatttttttgttaggatatagatattagttagaaaggtaagttgtttttttaaaatgttaaagttatagagagagaaattaaaataagtttattttgttggattaagaatgtttttttagaaatgttttatgggtttgtagaagttaagggttgagagagtgagaaggaaggaaggaatgtgtttgtatgtgtgagtggtttagtgtgtgaattaggtagagagagtgtgtggatgtgtttgtgtgtggaatggtagggatttgggaagtagttagtaggtagggtatttggtagttttttttggtagatatgtagttgggttattgtatagtgttggatgaatggtagtggggagtgagggg

SEQ ID NO: 633 - DNA, 8020 bp, Artificial Sequence
  chemically treated genomic DNA (Homo sapiens)
ggtgtatatttgtaattttagttatttgggaggttgaggtaggagaattgtttgaatttgggaggtggaggtggaggttgtggtgagttgagattgtgttattgtattttagtttgggtaataagagtaaaattttattttttaaaataaaataaaataaaataaaataaaataaaataaaaaagtaattaaaaaatttattgaagtttttataagaaataaaatttttataatggaaattttagttgattaaatttttatgtaattaaataagtatgagtgataggttttgtgttttgtttagtaatttaataattttttaattttttgaaagtagaattattttaatttttatttgaaaaatttttataagagtttagaaaagagttatgtaaattgatatttaagttatatgggtttgggtaatttatttttagtgtttattgttaagatgatataggatatattaggtttttttttttttgtagggttttattttgttatttaggttgagtgttgtggtgtaattaaagtttattgaaattttaaattttggggtttaagtaattttttaattttaattttttaagtagttgggattataggtatgtgttattatgtttggttaattttttgtattttttgtagagatagggttttattatgttgtttaggttggttttgaatttttgagtttaagatttgtttaatttggttttttaaagtgttgggattataggtgggagttattatatttggtttattaggtttttatttagtagagagaagatattaaagtaatatatttttaagttttttatgtattattttttttttttttttatataggaaatggtttgaagataatgatatagtgtgattttttgaaattttttttgggtagtggaagggtttagattttttttttttaatttaattagatgaagagtgagagtaagtagtatttaagagtatatagataggtatatatatgtatttgtattttaattattagggttgtgttagtatggaaagtatttaataaagatttgatagattgatttttagatgttgaattatgtgttttagtggtaaagattttaatggttttgttaaaattttagtgagtttttaagtattttaagatgttaaatatttgttttttatttggaaaatgtttataaatgttttatggggatatatttttattttaaaatttattatgaataaatattttgtaataaatagtaattaaagtatatttgttttaatttttgtagtaaaagattttataagagtaattaagaggtaattatttaaataataattatagaatttgtttataaaaaatatatataatatatatattttagagagatagggttttgttttgttttttaggttggagtatagtggtataattatgggttattgtagttttgattttttagatttaagttatttttttattttagttttttaagtatttgggattatagtgaatgttattatatttggttaatatttaaaaattttttgtagatatggttttattatgttttttaggttggttttaaatttttgattttaagtaatttttttgttttagttttttaaagtgttgggattataggtatgaattattgggtttggtttttaaaattatttttgatatagtattgtgttattattttgtaaatatagtttaaattaaatttttttaatgaatgtaatatatttattataatgtaatataggaattattaatagtaaatttttgatgtgagggaaattttatttttataaagtttagttttttattaaagtttattttaggatagtaattaatttttttaaaatataaaaggttatttatttatttaggtgaagttttgttttgttatttaggttggagtgtagtagtagattttggtttattgtaatttttattttttaggtttaagtgatttttttgttttaatttttgagtagttgggattatattaggtttagttaatttttgtgtttttggtagagatagggttttattatgttggataggttggttttaaatttttgattttaagtgatttgtttgttttggttttttaaagtgttaggattataggtgtaagttattgtatttggtttaaaaaggttttttttttaatttatttaaaggaggttaagtattttaaggtataagagttgtttatttaaaatagtaaatttagtatatttattttttttagattaaaattaatatattttgtattagtaaaataaataatgttatttgttttttttttttttttttttgagaaggagttttgttttattttgtaggttggagtgtagtggtatgattttggtttattgtaatttttgttttttgggtttaagtgatttttttgttttagttttttgagtagttgggattataggagtatgttattatgtttggtttttttgtatttttagtagatatagggttttgttatgttggttaggttggttttaaatttttgattttaggtgatttatttattttggttttttaaagtgttgggagtataggtatgagttattgttggtaggttgataattttattgtttttgaagagggtgtttaattattttattgtgataaaattttgtttgtttgttttttgagatggagttttgttttgttgtttaggttggagtgtaatggtatgattttagtttattgtaatttttatttttttattttgagtgatttttttgttttagttttttgaatagttgggattgtaggtttgtgttattaagtttggttaatttttgtattttttgtagagatagggttttattatgttggttagtttggttttgaatttttgattttatgatttgtttattttggttttttaaagtgttgggattataggtgtgagttattgtgtttagttgtaataaattttttaattttgaaaaatatattatttgggatgagttattagtaaagtataattttatatgtagtagtataaaaaatgtttagatgtttagggttttttttaaaattttattattttggaagattaataatagttttattaaataattttatatatgaatgaaaaatggagaaaaattttattaagatgttaattttattaaaatgaaatgggttattttttttttttgttagaaaaaaaaaggttgggaaaataaaatttataagttggttttttttttttttttttttttatgagttggttttaaggttatttttaatatttattttttttaatgatattaatatattgttatttatttgattttaaaattgtaattggttagttttaagtgaatataagtgttatgtttttgtagttttattatatttaatttgtaatttatttaataaaagattttaaatttataatgtatgtatggtgattaaaatatgagtatttttttaagttttgttattataatgtttgtttttttgggagtataatgatatggtttttttttttttttttttttgagatggagttttgtttggttgtttaggttggagtgtagtgatgtgattttggtttatagtaatttttgttttttgggtttaagtgatttttttgttttagtttttggaggaattgggattataggtgtttgttattatgtttggttgattatttgtatttttggtagagatggggttttattatgttggttaggttagttttgaatttttgattttaagtgatttatttgttttggtttttaaatataatgatttgttttaaggttgtaagtatttttattaggtatttatggggtgagtagggtggggtagatgtgttttggaatggggtatagtggataggaagtaatggtttataataatgtgaatgtttttgatgtgtagtgggagttttagaaagtgtggttgaatttgtagtttttaataaatggtttgtttttaaattttagttttaattttttttgagtgataggggtatgttattagtatggggggaaatgagatataagaaatgtttgaaagggaaaaataaggttgggttgttttttttttttggggttaagatagaggtatagaaggtttaggtttgggaggttggattatttttggttggatgttgagttgggtgggagtttaaatagtagggggtttataggaggttggtttaggtagttttgtgtttatttattaggttaggtttaggtatgtttttagtgatagtaggtttaggtatgtttgggggtttgtttagtttttgtttttgttgttttgggttatgggggtttttttgtttttgttttgttttttgggttttgtagtaggggtttttttgggttttgattttttttggttttttattttagatatgtttggagattttaggatgataagtttagggtagtttttttattagggggagtaggatgtggttgttttggtgtttgtgggaattttgggtggtgattgtgtttttttatagatttggtattgtttagagtttagttttttttttttttttggtatttttgttgttttattgagttttttagttgttagttttatagtttttttaggagaggtgggtggtgattttaatttatagtgttttttattgtgatattgttttaaatttgaggaaatttaaatttttgggtgtgtgtaggttgatgggatttgaggaggaggggtaggatgaaggggttgtgtgtgttatgttgggtgtgttgttgttgtttgagtttggtattggtgggaatgtggtgtgtttttgaggtttagttatgttttgtttgtggggtaggtgggtatttttatgtgtgtgggtatgagttgtggtaggagtgtgtggtggtagtggtggttgttttttggggtttggggtgtgtttatttgtataagtgggtgtgtgttgtttgggttgggtggatttggtgggatttgattgttttgttgtttagaggtggagaagaagaggtagtgagtggatgtgattgttttattttgggtaaaagggatagaattagaggtggggagtttgggtagttggtgatttgtgaagatttgaggtgttgtagtggtatttggagtagtgttgggttttttttggggtgtagttgttgttgggggaagggtgttataggttgggaagattttttttttttgtgtttagtagtggggtttattggagggtggtttgtgggttgggttttattgtggtgttttgggattgtggggttaggttgtgttgggtggatgtttattttgttaatttttggaggtttttgggggtttttgtgtgttttggggttgtagagatttaggggaggtgtttgtgaggtttggatttgttttggggtgaagggtatgtggtgagatagagttttgtatttttaatttttggtggaaaatttttgttgttgtttttttttattggtttggagttttttagttttgttttggtagtgttgttttttttattaagatttaggtgtaaaggtttgggtaagttgatttttttgtttttttttttgagttaggttttttggaggtttggtagttgattttagggattgagaatttgaggatatggaatatttgataattattttgtttttgtattaggaagagaaattttgtaatgaggaagtagtaaatttggggtttttgtggataaatgtgtgttgttttttgttttatgtttatgaagagttttggttttttattttgttgtgggttataaaaggttttgagatttagtttagataagttgtgtagttttaaaatgtatttaagatttgtatattttagtttaataggattaggtgaaattggaaattagttttagaaaattagagtgttttatttgtttagttattggatattatttaaaaaatttatttatttttgtttttttatattgaattttattattataaattaaggaatattttatgtttaagaggataaaaatgttattaatattttaaaaaatgagagttttgatttgaattaataattttttattagttttgtgtttttgttgggtattttgtaagttttgataagtataggtaaatgttttatgtttgtttttgtttttttaagtgttatatttggtgattttaaaaatagttattgaagtttgataattattgtttttttttgtgagttttaagttatttgtgttttgtttttgtattttgggtatttatatttttatttttttttttttttttttttttgagtagattgtgaattattttaggtaaatgatttaattttttttgtagttttggtgtttgatatatagggaggggtataaatgtgtattgaatgaatgaattgataaatttgtttagatttttttattttatatattgtgtaaagttttgttaatgttttgaaaatttgtagatattgtgaattgggttttatgtttatggaaaaatttgtattatatttgaaataaagttgttagaaatgttaagtattttattataaaggttgttattttttttttatgtttttttggtttgagaaattatattagaaagtgttttttgttgttttgtgggaaatgtgtttagtaaggaggatttagagttgatattttttttgaatgagaattaatatttaatagtaataatgttttatttatttttatgtttgataaggaaaataagaagttttttaatattaggattttaatgtaattattattttatataattttaattaaaaaaggaagtattttattgtaagaaatgataatgtgtgttaaaaaaaattgatagtagaggttgggtatggtggggtttataagtgtaattttagtatttttggaggttgtggtgggtggattatttgaggttaggaatttaagattagtttggttaatatggtgaaattttgtttgtattaaaaaaaaaaaaaaaataagataaggtgggggagaaattttaaattttgttatttagaagtaatttaaatattttgatgaataaatttttaaatgtttatatatatttatatgatattaatatttgtttttttttttgagatagagttttagtttgttgtttaggttggagtatagtagagtggttttggtttattgtaatttttgttgttttggtttaagtagtttttttgttttagttttttgagtagttgggattataggtatttgttattgtatttggttaattttgtatttttagtagagatagggttttattattttggttaggttggttttgaatttttgattttgtgatttatttgttttggttttttaaagtgttgggattataggtatgagttattgtgtttggtttttatgttatgtgttgtatgtgggattatgtttttgtttttttttttttttttttttagtaatagtattatgaatatttttttatgttaatatatggagatatgtgttataattttgaatggttgtataatattttattttatatatatattttaatttttaaaatttatatttagaatgatggatatttaggttgtgtttattattgaaatattttttattaatttttttttttttttattttttattttagttttttaatgtgttgggattataggtttgagttattatatttgattggaaatttattaattttttttgtggatatttttatatatgtatttgaatgtttttttgaagtaaatttttagaaatgggatttttgggttagagagaaagtttattttaaataattttatattttattgttttttagaaaaattgtatttattttttagtttttttaattagtgtataagaatggttatttttttatatttttttaagtattgggttttgtttatttaaaaatttttgttaaggaaaaaaaattagttttgttttttttatgttttttgtttattagtgagattatgtatttttttatatttttattggtttgataaatattttggtgttttggttgtagt

SEQ ID NO: 634 - DNA, 8020 bp, Artificial Sequence
  chemically treated genomic DNA (Homo sapiens)
gttatagttaaaatattaaaatatttgttaggttaataaaaatatgaaaagatatataattttattaataaataagaaatgtaaaaagaataaaattgattttttttttttggtaaaaatttttaaatggataaaatttagtgtttggaaaggtatgagaaaatggttatttttatgtattaattggggaaattagaaaatgaatgtaatttttttggaaagtagtaagatatggaattgtttaaaataagttttttttttaatttagaaattttatttttaaggatttattttaaggagatatttaaatatatatgtaaaaatatttataaggagaattaatgagtttttaattaggtgtggtagtttaagtttataattttagtatattgggaggttagagtaaaaaataaaaagaaaaaagaattaatggaggatgttttagtgatgaatgtaatttaaatgtttattattttgaatatagattttaaaaattagggtatgtatataaaatggaatattatgtagttatttaaaattatgatatatatttttatgtattgatatggaaagatgtttataatattgttgttgaaaaaaaaaaaaaaaaaaaatagaaatatgattttatatataatatataatgtgggggttgggtgtagtggtttatgtttgtaattttagtattttgggaggttgaggtgggtggattatgaggttaggaatttaagattagtttggttaagatggtgaaattttgtttttattaaaaatataaaattagttagatgtagtggtaggtgtttgtaattttagttgtttgggaggttgaagtaagagaattgtttgaattagggtggtagaggttgtagtgagttgagattattttattgtattttagtttgggtgatagattgagattttgttttaaaaaaaaaaataagtgttggtattatatgaatatatatagatgtttagaagtttatttattgaaatgtttgagttatttttgagtagtaaaatttgggattttttttttattttgttttattttttttttttttttagtatagatggggttttattatgttgattaggttggttttgaatttttgattttaggtgatttatttgttatagtttttgaaagtgttgggattatatttgtgagttttattatgtttggtttttattgttaattttttttagtatatattattattttttataataaaatatttttttttttaattaagattgtataaaatagtgattatattgaagttttaatattaagagattttttgttttttttattaaatataagagtgaatagagtattgttattattgagtattagtttttgtttaaggaggatgttagttttaggttttttttgttaaatatattttttataaagtaataggaaatattttttgatgtgattttttagattaggaggatatgaggaaagaataatagtttttatagtaaaatatttgatgtttttagtaattttattttaaatataatgtaaatttttttatgggtataaaatttagtttataatatttgtaagtttttaaaatattaatagaattttatataatgtatagagtgaaagagtttaaatgggtttattaatttatttatttaatatatatttgtgtttttttttatatgttagatattaagattatagaaaagattgagttatttgtttgaaataatttatagtttatttaaagaagaaaaagagagagagagtgggaatgtgaatgtttgaagtgtaaaaatagagtataagtaatttggagtttatagaagggggtaataattattaagttttaatgattgtttttgaagttattaaatgtagtatttggaaaaatagggatggatgtagggtatttgtttatgtttgttaaggtttataaaatgtttagtaggggtataaaattgataaaaagttattgatttgaattaaaatttttattttttaaaatgttaataatgtttttgtttttttaaatataaaatgttttttaatttatagtaatgaaatttgatgtgaaaaaataagaatgaatgaattttttaggtgatgtttaatagttaagtaaataagatattttggttttttgaaattaatttttaattttatttagttttgttaaattaaaatatgtaaattttaaatatgttttaaaattgtataatttatttgaattaagttttaaaattttttgtaatttataataaaatggaaagttaaaattttttatggatgtaaaatagaaaatagtgtatgtttatttatgaaaattttaagtttattatttttttattatagaatttttttttttggtataggagtaggatggttattaaatattttatgtttttaaatttttagtttttgaaattagttattaagtttttaaagaatttggtttggggagaaaagtgaggaggttaatttatttaagtttttgtgtttaggttttagtggggagggtggtattgttgggataagattgggagattttaggttggtggagggaaatggtaataggagttttttattgggaattaggggtgtagggttttgttttgttatatattttttgttttggggtaggtttgggttttataggtgttttttttggatttttgtagttttggggtgtatgaagatttttagggatttttgaaggttggtgaggtgggtgtttatttaatgtagtttgattttatagttttggagtgttgtggtgaggtttggtttatgggttgttttttggtggattttattattggatataaagggaggaggtttttttggtttgtggtgttttttttttgatggtggttgtattttggagggagtttggtgttattttggatgttgttgtggtattttaagtttttgtgggttgttgattgtttagattttttatttttggttttattttttttgtttgggatagagtagttatgtttatttgttatttttttttttttgtttttggatagtggagtagttaaattttgttggatttatttagtttggatggtgtgtgtttgtttatgtaaataaatatattttaagttttaaggggtggttattgttgttgttgtgtatttttgttatggtttatgtttgtgtgtgtagaagtgtttgtttattttgtggatggggtgtggttaagttttagggatgtgttgtgtttttattaatgttggatttgggtagtggtggtgtgtttgatgtggtgtgtgtgatttttttgttttgttttttttttttgggttttgttggtttgtgtgtgtttgggagtttgaatttttttggatttggagtaatattgtagtggaaggtgttgtgggttgaggttgttgtttattttttttaggggaattatggagttggtagttgaaagatttagtgaagtaatgaggatgttggggagagggaaggggttgggttttgggtggtgttaagtttgtgagggggtgtggttattgtttagggtttttatgaatgttaaggtggttatgttttgttttttttggtgaagaagttgttttgggtttgttgttttagggtttttagatatgtttgaggtgaagagttggaagaagttggggtttaagggagtttttgttgtggagtttgggaagtggagtgagggtgggaagatttttgtggtttggagtagtggaggtgggggttgggtagatttttgaatgtgtttgagtttgttgttgttggggatgtgtttgggtttggtttggtaagtggatgtgaggttgtttgggttggttttttgtgggttttttgttgtttgggtttttatttggtttaatatttagttggaggtgatttaattttttagatttgggttttttgtgtttttgttttgattttaaaggaaggaaatagtttagttttgttttttttttttgggtgttttttgtattttatttttttttgtgttggtagtatgtttttattgtttagaaggagttgaggttaaggtttgggaatgagttatttgttaagagttgtagatttggttatgttttttgaagtttttgttatatgttagaagtgtttatgttgttataaattgttattttttgtttgttgtgttttattttgggatatatttgttttattttatttattttataaatatttaatggaaatatttgtaattttaaaatagattattatgtttggagattgaggtaggtggattatttgaggttaggagtttgagattagtttggttaatatggtgaaattttatttttattaaaaatatgaataattagttgggtgtggtggtgggtgtttgtagttttagtttttttggaggttgaggtaggagaattgtttgaatttgggaggtggaggttgttatgagttaagattgtattattgtattttagtttgggtgattgagtgagattttgttttaaaaaaaaaaaaaaaagaaaattatattattatgtttttaaaggagtaaatgttatagtagtagagtttggaggagtgtttatattttgattattgtgtatgtattatgaatttaaggttttttattaagtaagttatagattgaatatggtaaagttataaaaatatagtatttgtgtttatttaaaattaattagttgtagttttaaaattaggtaaatggtgatatattggtgttattaggaaaaatgaatattagaaataattttaaaattaatttgtaaaaaaagaaaaaagaaaaaaattaatttgtgaattttatttttttagtttttttttttttggtgggaggagggaatagtttattttattttaataagattggtattttaatagaatttttttttattttttatttatgtgtaaagttatttagtaagattgttgttaattttttagagtgatagaattttagaagagattttggatatttagatattttttatgttattatatatggaattatattttattggtgatttattttaaatagtgtattttttagagttaaaagatttgttatggttgggtgtggtggtttatatttgtaattttagtattttgggaggttgaggtgggtagattatgaggttaggagtttaagattaggttggttaatatggtgaaattttgtttttataaaaaatataaaaattagttaggtttggtggtataaatttgtaattttagttatttaggaggttgaggtaggagaattatttgaaatggggaggtggaggttgtagtgagttgggattgtgttattgtattttagtttgggtaatagagtgagattttattttaaaaaataaataaataaaattttgttataataaagtgattaaatgttttttttaaaaataatagaattgttagtttgttggtagtggtttatgtttgtatttttagtattttgggaggttaaggtgggtggattatttgaggttaggagtttgagattagtttggttaatatagtaaaattttgtgtttattaaaaatataaaaaagttaggtatggtggtatgtttttgtaattttagttatttaggaggttgaggtaggaaaattatttgaatttaagaggtggaggttgtagtgagttgaaattgtgttattgtattttagtttgtaggatggagtaaaatttttttttaaaaaaaaaaaaaaaaaaagtagatagtattatttattttattaatatggaatatgttaattttgatttgaaaggaataaatgtattgaatttattgttttaaataaatggtttttatgttttaaaatgtttgattttttttaagtaaattgaaaaaaaaatttttttgggttaggtgtagtggtttgtgtttgtaattttagtattttgggaggttgaggtaggtgaattatttgaggttaggaatttgagattagtttgtttaatatggtgaaattttatttttattaaaaatataaaaattagttgggtttggtgtaattttagttatttagaggttgaggtaggagaattatttgaatttgggaggtggaggttgtagtgagttaagatttgttattgtattttagtttggataatagagtgagattttgtttaaataaataagtaattttttgtgttttgggaaagttagttattattttgggataagttttaatagaaaattaaattttatgggaataaaattttttttatattaggaatttgttgttagtgatttttgtattatattgtaatgaatgtattatatttattaggaagatttaatttgaattatgtttgtaaaatgataatataatgttatattaaaaataattttgggggttagatttagtggtttatgtttataattttaatattttgggaaattgaggtgagagaattgtttgaggttaggagtttgaaattagtttgggaaatatagtgagattgtgtttatgaaaaatttttaaatattagttaagtgtggtggtatttgttgtagttttaggtatttgggaggttgaggtgagaagatagtttgagtttgggaagttaaagttgtagtaatttatgattatattattgtgttttagtttgagagatagagtaagattttgtttttttaaaatgtatgtattatatgtgttttttatgggtagattttataattattatttaaatagttgttttttagttgtttttgtgaaattttttgttgtaaaaattgaagtaaatgtattttggttgttgtttattgtaaaatatttatttatagtaaattttgaaataaaaatatatttttataagatatttgtaaatattttttagataaaaagtaagtatttggtattttaaaatatttaaaagtttattagaattttgataaagttattgagatttttattattaaaatatgtaatttagtatttaaaagttggtttattaaatttttattaaatgttttttgtattgatatggttttggtggttaaaatataagtgtatatgtgtgtttgtttgtgtatttttaaatattgtttatttttattttttatttgattaagttggagggaaaaaatttgaatttttttattgtttaagaaggattttaaggaattatattatattattgtttttagattattttttatgtggaaagaaaagagaaataatatataagaaatttaaaagtgtgttgttttaatattttttttttgttaaataaaggtttgataggttaggtgtggtggtttttatttgtaattttagtattttgggaggttgagttgggtggattttgagtttaggagtttaagattagtttgggtaatatggtaaaattttgtttttataaaaaatataaaaaattagttaggtatggtggtgtatgtttgtagttttagttatttggggggttgaggttggaggattgtttgagttttggaatttgaggttttagtgagttttgattgtattatagtatttagtttgggtgataaagtgagattttgtaaaaaaaaaaaggtttgatatattttatgttattttgataataaatattggagataagttgtttaaatttatatggtttgagtgttagtttgtatagtttttttttaaatttttatagaaattttttaggtaagaattgaggtgattttatttttagaaagttaaaaagttgttaaattattaaataagatataaaatttgttatttatgtttatttaattatatagaaatttaattagttggaatttttattgtgaaaattttgttttttatggaaattttaatagattttttaattgtttttttgttttgttttgttttgttttgttttgttttgttttgagagatggagttttgtttttgttgtttaggttggagtgtagtggtgtaattttagtttattgtaatttttatttttattttttaggtttaagtaatttttttgttttagttttttgagtagttgggattataggtgtgtgtt

SEQ ID NO: 635 - DNA, 6523 bp, Artificial Sequence
  chemically treated genomic DNA (Homo sapiens)
gttggaaggagtgttttgatattaggtaggtgtgggttattgagttttttgggatttaaataggatgtgtatgtgggaggagggaatgggtgggaagaatttatgtttggttgagttttggttagtttgaggtgattttttagttttgggttgtaaggtttaggtttttggtgttagtggagaaggagagaatgagggagtttattgatttttaaggtgtatgagtgaagagtatagagtgaaggtttggttttttatggtttttgttttagtttaagaatttgtatttatgaataggggagtgttaggggaggggtaattttgggttgtgtttggagtgtaggttggtagggagtaaagttatttttgttattgttttttttggagtaggatttttaggttttttgtttggaggaggaggggtggggaatttgtaaaatttaataaagtaaaaaggggaggaggaaggaggggatttggtggggtttttgaggtggtttaagtattagtgtttttattttggtttgatttgtttgttattgaaagggttgtgtttgttgttggtgtttgggaagagagttgggttggttagttgtgtgtgtttattaatttgttgggtgggtggtgggtgggtgggttgggggttgtttgtaattttgttgttttggttgttgtggtttttggggagtgggttttggtgtttgtttttattggttgttgttgtgttagttggtgtgatttgttgttgttgtttttggtgtttggttatttagaaataaattagtttgatgattattaatagttatagttagatgtattaatatataataaattatagttttgtagaggggtgtgtaaatgagtttttattttgtgaattttattttttttgggagtttttttagtggttaggatttttttttgggttagttgtttttttattaggttggttatgatgtgttgaggttttttttggttttgtatggggtgttgagttttttggataagatgtatattttattttgtttttattaatagtttaatttggttttggtttgtaattgggtgttttatgagtatggggttttgtgtttttattttgataaggattttagtggtgttttgtttttgggtagtggtaagtagaggggttttggggattatttgtattttttttttgagtagtagtataaatttgatagtagtagtgggtagggtaaagtattttatgatgaaggtgttgattggaagtatatgagtttggtttatttttggatgtagtggatgaatttttgtgtgggtaagatatattttaagatagtggagggagaggggaaaggaggtaggaaaagaaagaaagaaggaggaaatagagtagaaagaggaatagagagaaagaaaggatgaaagaattagtaaagtttttttggttttttaaaagagaagaaaaaattagtttttaatggggttattaggttatggtagaggaagggtaaggttttagtgtttatgtaagttgatattttaggggaggatgggggtattggtatgtatatgagatttgtgatagggatagtttgaagagagagagaggttggtggggagggatagtttgtttatgtattttgagtattttgtttagttttttaagttagagggttttttgtattgtgttattgataaatattttttgttttttaatttttttttttttttgttttttagaaatttgtatagagaggtggttatttggttttttttagtgtttttttaaagttttggagggttatagttttagatttaggatttttttttttttttttttttattttttttggtttttatttaattgtttatttttagttaatttttgtttttttttgagtttatgtttgagttttatatatttgttttggagggattttttattatttttggggaattttggtattagattagatagtttaatataattttatattgttagaaattttagattatttatagttttattttttagtttttggtttttaaggattttatagggaattttaaagatttttaggaattttttaggatagagtttaatgtggattgttaaaattataatgttttttattaatatttattttatttttgggggagttttgtattttttagaagggttatataatttgggagaatgtgtaaagatttaagagggttgattatttttaattttttaaaaaatgtgttgagttttgatatggttggttatagtagtatttttagagagattattatgaatttagagtgtgtatattatttatatggttttatattatttattttagatatatatatatatatatatataaatatatatatatattttgtatttttataaaaatatgatttgggtattttaaattaagaatgtttattttgttattttgtttgtaatggtttttttatgaggtagattttttaaaaatgataatgtttattttaagttgttataggtggaaaatattttgtttggtatgaaataattttttatttagtatgttttgggttttagatatagtgggagaggttggagtggaggtggggtggtttttagtttgggtgttttttgtgggaggtattgggttgattgggttaattttttaggttttggtttattggtgtttggttgtttttgtttgtaggtgttgtgtatgggagttatgggtgttgaggttgttagatttatatgtgttattagatattggagttggagaaggagttttattttaattgttatttgatatggtgttgttgtattgagattgttaatgtgttttgttttattgagtgttagattaagatttggttttagaattgttgtatgaagtggaaaaaggaaaataagtttattaattttatgtagtttagtggggaggatttagaggtaaaggtgggtgagtagatgtttgggtagggattaggttagtgttgtaattttttttggttttgtttttttgtttttgtttgttttttaatttttttttttgtttgtttttatttgggggtttttgtagttttaggggagtttggagttttgtaagtgtttgtgtatttattttttataaaataaaataaaataaaataaaataaaataaaataaaataaaataaaattttatatatagttaatattagtggtggagtggggtgtattgtatatatttagttttgttttataaggatgtttaaattggttttggagttttggggtgtgttttgaatgtgtttggggtttttgtgttagtgtttttgagttttttgattttgggatgtggggttgttggggaggaaagagttttgggttgagttttgttttgtgtttgggtgtttttgtttaagttttttgttagtaagttttgaagggtattattaaattatttttggttagtggaaagagggggtttaagagttggagtttggttttgttgtggttttttaagttgttttttagaataggaaggaagtttgaggaataaagggggttttaatagagtttagttttttggttttgtgtgtgtaattgttagtggaagagaagtagttttagttgaggtgagttaatttgggtgtgggtggaatattatagtttggggtaggtttttggttttggatttttgtttttagtttttgatagtgtttgtgttgttgttatagtagtgtttaggatttaatgaggggtttagggttatgggagttgttagagttttggtttttagatgtgttaggggtgtttgtaatgttgggtttttagtggggagattttatttgttttttagttatatttgtgatttatttgagttttttggagttgtggaaaataattatagagatattaggtattgttaaggaatgtttttattattgtttttattttatttttggaggtttaagtaagattttagtaatttgttttatggatttttagattttaggtagtttttgtggttgtagggagtttgggtttatttgttgggtttaaggagaattttttgatttggggtttggttggtttgaggaattggattttgtgatgaagattttttaggttggatatgtaagtaaattaaattgtaaattaatgatatgaaaattatatttatatgaaagaaaaattgattatggttataaaagtgtatggaatttgattttgttttggagaaatattatataaaagttatttttaatagatgtttgttatttaagagtggtagggatattgttttttatgtgtttgtaaaaatagagttgtaattgtagttgttgttgttgtgggtaggatttatttttttaattggttaaatggtttttttttttttttgaaggtgatatttgtatttttaaaatttagagttgttggtaggatggttagtattgattttaattttgatataaaaataagaggggttgtaaaatgggggaaataaagttgttgtaaataaaatgtaagttattatttttttttaattttttgtatttttgttgggtgtgtgattggtagttgatggtttaataattggtatattttaatggaattgtgagggaaatgtaataattttgttataatgggttgtaattttaatttgattttggtttttgtagtttttggttggaagttgggtgatgagttttgtttttagtgggtggtgtttgagtttggttgaatggtggtaattggtggtgggtatgtgtttggggtgtgtgtgttattttttttgtttttatttaatttttttattagtgtatgagtttatttttagaggttattaggtaggatttatgattggataataaaagtatgtgatttgaagttgtattttatatttgggtgtttatgtaggagggaattaagtatatgttttagttatttttataatttattataaattgtgtaagggtgttatagatgtataaatgattgtgagttataaattaagtatatatattaaaaaataaatgagtttttattttgtaaatttattttgtggttgttatttaaatggtttggattattagttgtataattatggagattatagttttgtgagtgagtaatttagggatttggtgagtatgtattttggtaggtatggttatggttataatggtatggattttagtgttggttgtttgggttttggttattttggttttggagagtgtgtttgtagttatgttgttagtgttagtgtggtgtttgttgagtttaggtatagttagttggttatgtttatgtattttttttagtttgatttgttgttttgttttgttgtggtttttttgtttggtagtgatagttattatggtgggaaaaattttttaagtaattttagtggtgttttggttgatgttggtagtatttatattagtagtagagagggggttggtatggtgtttggagttgaggaggatgtttttgttagtagtgagtaggtgagtgtgtagagtgagttgagtttggtgttgtttgtttaattttagatttatttttggatgtgtaagttgtatataagttatggtaaagttagtttttttttaaatttatgtgattgtggggatgtggtttttggtttttttttttttttttgttgtttttttttagttttttttggttttattttttttagttttgtggagttttttttgttgtttttttttttttgttttttttttttttttttttttttgtgagtattttgtgtttataaatagtgggggaaatgggtgttttttgggatagtttagatgttggaagggggaggaagtaaaaaatttttttggaattttatgttttgggatgtgtttttgggttaggttagttgagtaaggtgtagagaggtagaggatggttgtagtagttgtgaattgggtttgttatggtggataatttatgaggagggttatgttggggaaatagtgttattaattatagtttttgaaaaggggtttgggggaaagaattgaggtgagagtttgtaggattttgaattttgggggtaggagggagagagaaggaaagggaagaaaaagaaaataggttttttaattttgtaggttggaaatgggaggtggtttttggggttggaattttgagggagggtgatttgaaggttatttgggtgtttaggaaagggttttgttttttgggtttttgtgtggtgggtagtttgggagggttgtgttttttgattggggtgtttggggtagggtggagggggtaggagaggggttagggaaagttggagtttgttgggatatggttttagttttagatgggtagattgtttttagggtttaaattgtattgttttttttttagaaaggaagagagaaggaaatttgggaggggtgtgtgggttggtaggtagaatttgttgagttttttgtttgggttttttgtttatgatttaagtttgtttttttggtggattttggaagataggagttggtggttaaattgttgatttttttattgtaga

SEQ ID NO: 636 - DNA, 6523 bp, Artificial Sequence
  chemically treated genomic DNA (Homo sapiens)
tttgtaatagaaaagttagtggtttagttattaatttttgttttttaaagtttgttagggggataagtttgggttatgagtagggaatttaggtgaaaagtttaataagttttgtttattagtttgtatattttttttgaatttttttttttttttttttttagaaagaaaataatatgatttggattttgggaataatttgtttatttgaggttggggttgtgttttggtggattttggttttttttggttttttttttgttttttttgttttgttttgggtgttttgattgggaggtatagtttttttaggttgtttattgtatagaaatttaggaagtaaggtttttttttgagtgtttaagtggtttttgggttatttttttttaaagttttagttttgagagttgttttttgtttttagtttgtagggttggggagtttgttttttttttttttttttttttttttttttttttttgtttttaaaatttagaattttgtaggtttttgttttgatttttttttttaagtttttttttgggggttgtaattagtaatgttgtttttttagtgtagttttttttataaattatttgttgtgataagtttgatttatggttgttatagttattttttatttttttgtgttttgtttggttggtttgatttgggagtgtgttttaaggtgtggggttttagaggggttttttgtttttttttttttttaatgtttaaattgttttagagaatgtttattttttttattatttgtgagtgtagggtgtttgtaaagaagaggaggaaggaggaaggtaggggagggagaatggtaaggagagttttgtagggttgggagaaatgagattaagagagattgggagagggtggtagagaagagaggggggattgagagttgtgtttttgtggttgtgtggatttagaaaaaggttggttttattatgatttatgtgtagtttgtgtatttaggggtagatttggggttgggtgggtggtgttgggtttggtttgttttgtgtatttgtttgtttgttgttggtaggggtgttttttttggttttggatgttgtgttaattttttttttgttgttgatgtgggtgttgttggtgttggttgaggtgttgttggagttgtttagggagttttttttgttgtggtggttgttgttgttgggtgagggggttatggtggagtagggtagtggattgggttgaggagagtgtgtggatgtggttggttggttgtatttgggtttggtgggtgttgtgttggtgttggtagtgtagttgtgggtgtgttttttggagttaaagtggttggagtttgagtggttgatgttgagatttatgttattgtagttgtagttgtatttgttggagtgtatgtttgttgagtttttgaattgtttgtttatggaattatgatttttataattatgtaattggtagtttgggttatttggatagtgattgtaaaatgagtttataaaataagagtttatttgttttttgatatgtgtgtttgatttgtggtttgtggttgtttgtgtgtttatagtatttttgtataatttatgatgaattatggaaatgattgggatatgtatttggtttttttttatgtaggtatttaaatatggggtatgattttgaattatgtgtttttgttgtttagttgtaaattttgtttgatgatttttagaggtaaatttgtgtattaataggggagttgggtggaggtgaggggggtggtgtgtgtgttttgggtgtgtgtttgttgttagttgttgttgtttagttggatttgagtgttatttgttggaggtagggtttattgtttagtttttgattgggggttgtaagggttggggttgaattgaggttatagtttattatggtaaaattattgtattttttttgtagttttattaggatgtattaattgttaggttgttagttgttgattgtgtgtttggtgaggatgtagaggattggggggaggtggtgatttgtattttatttataataattttattttttttgttttgtagttttttttatttttgtgttgaggttggggttggtattgattgttttgttagtagttttgaattttgaaaatatagatattatttttggggaagggggaaagttatttagttaattggagaaataaattttgtttgtagtagtagtagttataattatggttttgtttttgtgagtgtatgagggatagtgtttttgttgtttttaaatgataggtgtttattaaagatagtttttgtgtagtgtttttttaaggtgaggttaaattttatatatttttataattgtagttgattttttttttgtgtgaatatggtttttgtgttattagtttgtgatttgatttgtttatgtatttagtttggaaaatttttattatagggtttggttttttgagttagttgggttttaagttggagggttttttttgaatttagtgagtgggtttaggttttttgtagttatagaggttgtttggggtttggggatttgtggggtgggttattggggttttgtttagatttttaggagtaaaatgagggtgataatggaagtattttttggtagtgtttagtatttttgtagttattttttatggttttgaaagatttaagtaaattataaatatagttgagaggtaagtggagtttttttgttggaggtttggtgttgtaggtgtttttggtatgtttggaagttaggattttggtggtttttatggttttgggttttttgttgggttttgaatgttgttgtggtggtgatgtgggtgttattggaggttgggagtgggaatttggagttgggagtttattttgggttgtaatgttttatttgtgtttaggttaatttgttttggttgaggttgttttttttttattgatggttgtatatgtgggattgagagattgggttttgttggggttttttttgttttttgagttttttttttgttttgggaggtggtttgggaggttgtgataaggttgggttttagtttttagattttttttttttattggttagagatgatttgatgatgttttttgggatttattggtgagggatttaggtagagatgtttagatatgaaatggggtttggtttagggtttttttttttttagtagttttgtgttttgaggttggggagtttagagatattagtataggagttttagatgtatttagggtgtattttagaattttggagttggtttgggtatttttgtggagtgggattgggtgtgtgtagtgtgttttgttttattgttggtattggttgtgtgtgaggttttgttttgttttgttttgttttgttttgttttgttttgttttgttttgtaagaaataaatgtatagatgtttgtaaagttttgggtttttttgaagttgtggaagtttttagatgggagtaggtggggagaaaagttggggaataggtgagggtaagggggtaaagttgaaggaggttgtagtgttggtttggtttttgtttaggtatttatttgtttgtttttgtttttgagttttttttgttgggttgtgtggaattgatgagtttgtttttttttttttattttatgtggtggttttggaattagattttgatttggtgtttggtgaggtagagtgtgttggtgattttgatgtggtggtgttgtgttaggtagtggttgaagtggaattttttttttagttttagtgtttggtagtgtgtgtaggtttggtggttttggtgtttatggtttttatatatagtatttatgagtagaaatggttgggtgttggtaagttagggtttggagggttgatttagttagtttagtgttttttataagaggtatttagattagaaattattttgtttttattttagttttttttattatgtttggggtttaaagtatattgaatgggagattattttatattaagtgagatgttttttatttataatgatttggggtggatattattgtttttgaaaaatttgttttataggaaaattattataagtaaaataatagaatgagtatttttaatttgggatgtttaggttgtgtttttgtggggatgtagggtgtgtgtgtgtgtttgtgtgtgtgtgtgtgtgtgtgtttggggtgggtggtgtggaattatgtaagtagtgtatatattttgaatttatagtggtttttttgaggatgttattgtgattagttatgttggaatttaatatattttttgaagagttaaaaatggttagtttttttgaatttttatatatttttttaaattatatgatttttttgagaaatgtagaatttttttaaggataaagtggatgttaatggaaaatattataattttaataatttgtattaggttttgttttagggaatttttaggagtttttgggattttttgtggagtttttggaaattagaggttaagagatggagttataggtagtttaggatttttggtaatgtaggattgtgttgggttgtttgatttggtgttaaagttttttaagggtggtggggggtttttttaagataggtgtatgaagtttaggtatgggtttagaagagggtagaagttggttaagagtgggtagttgagtagaagttgggggagatgagggaggagagagaaaaaaattttgagtttggggttgtggttttttaaggttttggggagatattggaagaggttaaatggttatttttttgtatgggtttttgaagggtagaaaggagagggggttgggaagtaaagggtatttattagtgatgtagtgtaaaaggttttttggtttgggaagttgagtagggtatttagggtgtatggataggttgtttttttttattagtttttttttttttttaggttgtttttgttataggttttatatatgtgttagtgtttttatttttttttaaggtgttagtttatatggatattggggttttgttttttttttgttatggtttgatagttttattgggaattgattttttttttttttttaagaagttaaagaaattttgttggtttttttattttttttttttttttatttttttttttattttgttttttttttttttttttttttttttgtttttttttttttttttttttattgttttgggatatgttttatttgtgtaggagtttatttgttgtatttaagggtaaattgggtttgtgtatttttggttggtgtttttgttatggagtgttttgttttgtttgttgttgttgttgggtttgtattgttgtttgggagaaaagtgtaggtagtttttggggtttttttgtttgttattgtttgagggtgaggtgttattgaggtttttattagaatagaaatatgaggttttgtatttgtaggatgtttggttgtaggttaggattgagttggattgttggtagaaataaggtgaggtgtatgttttgtttgggagatttgatgttttgtatgaggttgggaagggttttagtgtgttatagttagtttggtagaggggtagttggtttaagaaggagttttggttgttgggaaggtttttggggaaagtgggatttataaaataggaatttatttgtgtgtttttttgtaggattgtgatttgttgtgtattagtatatttggttataattattagtagttattgaattggtttgtttttggatggttgaatgttaaaagtgatagtagtaaattgtattagttgatgtggtggtggttaatgggagtgaatgttggagtttgttttttggggattgtggtgattgaggtagtaaagttataaatagtttttagtttgtttgtttgttgtttgtttggtagattaatgggtgtgtatagttagttggtttggttttttttttgaatgttagtggtgggtatggtttttttagtggtgagtagattaggttagagtagggatattaatgtttgggttgttttaaaggttttgttaggtttttttttttttttttttttttttgttttattgaattttgtgggttttttgtttttttttttttaaataggaaatttgaaggttttgttttaggaggggtagtgataaaggtggttttgttttttgttggtttgtattttaggtatggtttagagttgttttttttttagtgtttttttatttgtgggtgtgagtttttgagttggagtaagggttatgagaaattaggtttttattttatgttttttatttgtgtgttttaggaattggtgaatttttttattttttttttttttgttagtattaggggtttgggttttgtagtttagagttgaaggattattttgagttgattaggatttagttaaatgtaggttttttttatttattttttttttttatatatatattttgtttgagttttaaggggtttaatggtttgtgtttgtttggtgttaaagtattttttttagt

SEQ ID NO: 637 - DNA, 10224 bp, Artificial Sequence
  chemically treated genomic DNA (Homo sapiens)
agtttttatagttttagtattgttttttttattttattttgattgtgtttttgttgtttatttttgtttatttattttaattttagtgttttttttagtttttgggttttaggtgatatattagttagtgggatatgggtttttataggtatttttagtttaatttagttttttttttttttttggttttttggttagtatttgtattatattggtttttattggatatttttgtagttttgggttttttttatagatatattgttggattagttgtttaatttggtttatttgtagagttttttggtttatttgattttaattgaaatttagttttttaagaaggatttggtgttggaataggtaggtattggaaagttagttgtttaggattattgttttattttattagtatttttttgttattttttattttttttttttagattttagaaatttgggagtggttggagtgagaaaatagaggtaagtggtaggtaattgttaagtattagttttagtatgtgtttagttttttagagtaggatttgtggttgtaggtgtgaaggtaaggtttgtggaaatggtagggagggtggaggggatgtaggaggtatggatgtgggtggggtgtttttattttttagggttagttagatttttttgatttttttttaggtgggttgagatttataggttggatgtgttagaggtagtggttttagagtggttttgttgtgtttattgtagtgtagaggtttttaagtgttgtttatgatgttagaatgagtggtattgttgtaggtgagggtattttagaattttggatttttaagttttatttttatattttttatatgtattgttatttttaatatttatttgtttgtagggagtgttaagttaagtattgggaaaagtatggaaagatttgtgttttggtagtttagggtgatagagttaaatgagggttgtagttgttgagggttgattatttatgttaagggaatttatttagaatgtatttttgaattttaagattatggtttagtttttgttggagttttagtttttgtagtggagagtagagtgggtggtaaagttgttgattgattttttttttttttattttaagtgaaggtttgagattttttgttttatttagtgggtaggttaagtgtgttgttttagtaaattggattaggagggttagggttggatgtggggattttttttttttagtatagtaaagttggtttttagaaatatgggtatttttgtgtggtgttttgtggttgttgttgttgtggttgtttggggtggggtgtgaggaggggatgaaggagggaaggaagggtaaggtggggggggttttgtgagagtgtgtttagttttgtttttgggttttatagtttttgtatttaggtttttattgtgtggttttttttagtttttttttgttgtttagtttggattttgggggaggtgttgaagttggggtttgttttgtggttttgtttggtttgtgtttgttagtgtttaaagttagtgaagtatgggtttaattgggttatgttgggggagtttgagtttattgagttgtgggagttggtatttgttgggtgtgttgggaagggttgtatttggttggagtgtgttaatgtgttgtgtattgtgtggggtattgtgtgtaattttatatggtagttggtttttggttgtggttattgtttttagtttgtggggtttgttatgtatatgtggtgtgatttttgtggtgattttatttggggtgttgtgtgtaaaggtttgtagtgtgtgtgtgagtagtggttttgtgtgtttatgagagtggaaggggtagttaaggggtagtgtagttgttgtgggttaagttgtggtagagggggttggtggggatagtttttgaggattaggtttgttatttttgttttattgttgaagagtgtgtgaaaatggtttattttttgttgtattttatttgtatttgggttatagatgagtagaggtggttgtttatatgtaaaaatatgttgattttaagttttttatttttaaaatgttttggttttttttgagaaagggtttgtgtttattgtttttggagtttatttttttaggtttgtttttttttaaatatttatgattttttttagaatttttagggtgaagggaaattattatttatgggagggagtttggaaaaatttagaatttttggtgggttttttgtaagtaggagttttgttgagtttttatttagtaaatatttttttttgatttagtgaattagatgttaaaatatgtatgtagttatatatttagtagtttttttgtatttttgggaattgttagtaagtaaaggttgtttttttttgggtagatattagttggaattattaggggtgtttttatagttttttttgttagtttggattttattgtagatttgttgaattaattgttgggagtggattttaggtattagtaaattttaaaaattttttaaattattgtaatatggagtttgggttgagtattattgttttggtttatttaggaatttgtggatggatagtgttttaggtttgtgtgtgtatggagatttttttatttggtataagaggatattataaatttagttggggggagtataaagttgtgatagaatgtaaagaatgaataaggggttgagtgtggtggtttatgtttgtaattttagtattttggaaggtggaggtgggtggattatttgaggttaggagtttaagattagtttggttaatatggtgaaattttatgtttattaaaaaataaaaaaaaatgagttaggtgtagtggtgggtgtttgtaattttagttatttgggaggttgaggtgggagaattgtttgaatataggaggtggaggttgtagtgagttgagattgtgttattgttttttagttttggtgatagagtgagattttgttttaaaaaaaaaaaaaaaaaaaaaaagaataaggttgggatattgtagtgtttttaaagagaaataaagtagttatggagataagaagtaggatgatttgggtatgtttattagaggtagagataagggagaaattaaagataagtttgggtttttgtttttagtaattgggagtttagtggttatttttgttgtaaagaggaagttgggtaagtgtagtagtgaggttgaagaaaagggaattaaattttggttatgtttatttgaaatgttttttagatattttagtgaaggtattggtatggaggatttagtttgagggtttaggttagtgttttagttgtggatttggggtagatgaatgtagatagattaggttagtgattaggattgagtttagattttattgtgagatatggaagttgagttagaatttgtaaaggagttgagtaggagttgtagggggtaggaggaaaattgggagagtgtagtttttgggagttaaagggagtaagttttaaatgatgttgagggggtgagaatggagaatggaatattggattttatttggtagtatatagattgttgaggattttgttttgggtagttttttggaggaagaggtaagtttggttggagtgggtagaggggagagtgaaggtgaaggattagagtgtatagagattagtgttttggtttgaggggagtagagataggtgataattatagggtagatgtaggttaaaggtgtttagttttttttttaagtaaatgggtagatgtattttatatatgtttttagtgaagggttgggtgtggtggtttaagtttgtagttttagtattttggaaggttgaggtgggtggattatttgagattaggagtttgagattagtttggttaatatggtgaaattttgtttttattaaaaatataaaaattagttgggtatggtggtgggtgtttgtaattttaggtatttaggaggttgaggtagaagaattgtttgaatttaggaggtggaggttgtggtgagttgaaattgtgttattgtattttagtttgggtgataaaagtaagatgtagttttttgttgttgtttttttaattgttaatgaggaaaggggaagttttgtgttaggtgatagagatttaattgttgagtaggtttttttgtttgtggttttttggttggtttttagatgtttaggtggttaatattagagtttgtgtagtagtgtgaggtaatttattgagataggttgggtttgtggagtttggtgagtagtggttttttttttggggtttttttttaatttttgggatatttttttgatttggagtttttttgttttattgttaggtttttttgtagattgtaagtttatttgttattattgttgttgtgtgtttgtttgtttggattgttgtgggttttgggatttgggttgggaatttgtggtggagtgggatatgaatgtggtgagtgtggggttgagggtgtatgggaagggtgaggatgggtaggttatagtgtaggtatttttgagggttgtttgggtgttgtgtgtaaggagtgttttaattgttgattttttggtggtatagagaggttaattttgtgtgggggttgggaggggagtttggattgttggttttgtaagtattttatttgttgtaagtggatttgggtttaggttgatttaggttttgtgtatgtgtattttttgtatttttttgtttttgtttttggttagaggttatttttgtgtgtttgtttggatgttggtatttgtttttgttttttgtggtaggtggggtttgtgagtggagttttggagtgatgaggttatttttgggggtgaagtgtgtgtgtttttgttttggtgtttttgttttaatgagataagagttagattttggtgatttatgttttagttttaatggttgtggtgtggttttggtttgggtgtatgtgtatattgatatgtgtatatgtatgtatgtgattggggtggtggttggtggttatggatgtgtaggattgggggatgggtgggtatggttatgggtgaggtggaggtgtttttttttgaaatgatttggagtagtatgatgagtagtggttattgtagttaagaggatttggatttggagtttgagtagtattttattgtgtgaattttgttagtttgtaggttgtgttgggattaggtgggagttagggggtgttggtgggtgggaggggaagtggttgttggagttttgttttttttggtttgttgttgtgttttgggttggtgggtagttttatttttttggttatgtggttttttgtgggttttggttggggatttgtttgtggaattgtgtgtaagattttgattttattgtttagatgttgggtgttggggtttttttggtttttgttatagataggttgaatatggaaaaagtagttgtatggtttgtggtagatttgagttgggtattatttagttatgattaaagttgattgagtagtttggattagtattttgatttttgtgtttgaatgtttttgttttttttttggggagattaggggaggatgtggagagggaagagtttttgttaggaattgagaagtatgtttaggaaaatttgagaggtagagagagattttgtttttttatttgtatttttgtatggagttagttgagtttttattttttttttgttttggtttgttattagttgttggaatgtggaagattttgttttttttttttagggtggatttggagaaagatttgggaatagataggaaagaagttttgttttggattataagtatttaggagtattttatttataggaagggggaaagttagattataaaatgtttaaagaggtggaaaaagagatttaggttattaatttaggattgtaaggtgttttggaattttttaggtatttttattattggagaattgtgtgttagatgttattggtgtgattattaggtttagagaattaggtttaggtattaggaaaaagaaatagggattgtgaagtttagtatgtttggtagaaatggggtggaaatttttatttaagtaaagaaagtggagttgtgagtgatgttttagataaaattttataaaattttttataaaatgggtggtgtttagtatgttaaaattttagtttagagtttgggtgtaagggttgagttgagtgtagatttttgggtttgtttttatgttagttagttttgagttattttttattgtggaaaggtgggaaaattataagatattaattaattgaaaaggagggttagttatggaggtgtatatttgtaattttagttatttgggagggtgaggtagaaggattatttgaatttgggaggtagaggttgtagtgagttaagattgtgttattgtattttagtttgagtgatagagtgagattttgttttaaaaatagaaaaggaagttaagtatggtggtttatatttttaatgttaatgttttgggaggttaaggtaggtggattatttgtaattaggaatttgaggttagtttggttaatatggtgaaattttatttttattaaatatataaaaattagttgggtatggtggtgtgtgattgtagttttagttatttgggagattgaattattttaattgggaggtaaaggttgtagtgagttaagattgtgttattgtattttaatttgggtgatagggtgaggttttgttttaaaaaaaagaaagaaggttgggtttggtgatttatgtttgtaattttagtattttgggaggttaaggtaggtagattatttgaggttaagagtttgagatttgttaggttaatatagtaaaattttgtttgtattgaaaatataaaaaaattatttggttatggtggtgtgtgtttgtaattttagttattggggaggttgaggtaggagtattatttgaatttagaagatagaggttgtagtgagttgagattgggttattgtattttagtttggatgagagagtaagattttgttttaaaaaaaaaaaaaaaaaaaaagaaagaataggaggttgagaagttttaagttatatgttaaaaaaaaagaaaaaaatattagttttaggttaggtgtagtggtttatatttttaattttagtattttggaaagttgaggtgggtggattatgaggttaggagtttaagattagtttggttaaaatggtgaaattttgttttgattaaaaatataaaaaattagttagttgtggtggtaggtatttgtaattttagttatttgggaggttgaagtagagaattgtttgaatttaggaggtagagattgtaatgagttaagattgtattattgtattttagtttggaaaatagagtgagattttgttttaaaaaaaaaattattagtttttatggatagtggtagagtggagggtgggtttttatggtgtagaagggaaattttatggttttgttgtgtatttgattgggatggttgttgaaatttttttttagtaggtagttttggaaatagaaaaagaaatttttttttttttagaattttggaagggttgtgtagtgtttttaatttaagtttgttttttgagtgaagatagggaggtttattattagaagggaaggggttggaaatgaggttattgtattttagtttagggtttttgggttatttaggaagggaagaaggagtaagtttttttattgttaggtaggagtttagagttattataagaataagttagtattatttttgtgttttttttgttttgtaaataaaatgatttttttttttgttttggtattagagtttgtttggtattttttttgtttttagtattttttttatttgggtatttttttttgttggtgtattgaataaatatatttattgttttatttatagtttttagtttttattttttagggtttatattatttgtttttattaatttgataaggttgtttattgtttttagtaaggtttgtattggggtttttattttagtgtttttttttatttaggagatttttggatatttggggaagaaaatgagtttaaatttttatttttttttttttattttttttttgtaaggttttggttttagtttttagttttatatttttgttggttgtagaatagtagtgggttttgggtaaggagtattttgttaaaatgttttattttgtttttttatttgttttttttatttgtttttattagatggtttaagtgtttaaggggattttagggtggagttagggagaattttggtttttttgggttaggtataagattattttataggaaattttgtgggaatttttttgggataaagtattggttagtgttgagtttagttgtgtttgtgatatttgtattttaattagggtttatttgatgttaataggaagtaaggttgatgtagtggggttaagggagtttgggagaagaaagttggtttagagttttggttgttttgttttatattttatttttttggtaagaatttagtttttagatgaggtggggagtgagtggttgagttaaaaatttttgggttgggtatgatggtttatgtttgtaattttagtattttgggaggtgaaggtaggtggattatttgaggttaggagtttaagattaatttggttaatgtggtgaaattttatttttattaaaaatataaaaattagttgggtgttgttgtggtatgtgtttgtagttttagttatttgggagtttgaggtaggagaattgtttgaatttaggaggtagaatttgtagtgagttaagatttagttattgtattatagtttgggtgatagagtgaggttttgttttaaaaaaaaaaaaaatttttgggttaaatttttagatagtataggtaggtgtagaaatttattaggaagttgtttgtgtatttttggtagattggagtttggtttaaagttgttttttatgtagtttgggttaaggttaaatattatgttatagtgattttttttattatgtgtgagatatggagaattggttttaagtattattttgtttattggtggttggattattgatgtgtattattttttattttttttattttgtagtgggttatggttttgtgttggggtagaggagaaaaatgggttgttttttttaggataaatttttattttaatttaattagggtgttgtgattagaatgtgtaattgaggtgtgattttattgattttttttttttttgagattgagttttgtttttgttgtttaggttggagtgtgatggtatgattttagtttattgtaatttttattttttgagtttgagtaatttttttgttttagttttttaagtagttgggattataggtatgtgttattatgtttggttaattttgtatttttagtagagatggggtttttttatgttggttaggttggttttaaatttttgattttaggtgatttatttgttttggttttttaaagtgttagaattataggtgtgagttaatgtgtttagtttgtttttgttttttgtgttttgaagtagggttttatttagttttttaggttggagtgtagtgatatgataatagtttattgtagttgtaattttttgggtttaaatgatttttttattttagttttttgaatagttgggattataggtatattattatatttggttaatttttttttttttttttttagtagagatgaggttttgttatgttgtttaagttggttttaaatttttgaggattaagtgatttttttattttagttttttaaaatgttgggattgtagatgtgagttattatatttagtttgattttattttaaatgagagtttttttttagagttttttagttgtttttggtttttggttatgtgtttttagttgtttttgtttttgtggtatttttaaggttatatttagtgttgaggttttaggtaggtagtagagagaagttaaatgattttgttttttttttatttatttagagtatgtaaaattaggagtagtggtgggtttagggtgggtattagttatgtatatgtatattagggatagggggttaaaggtagttagtttttaaagattgttttagaggttattttttagagaagttttgggttttttaagggttttgtgtttatgttggtttattttgtagg

SEQ ID NO: 638 - DNA, 10224 bp, Artificial Sequence
  chemically treated genomic DNA (Homo sapiens)
tttgtaagatgggttagtatggatatagggtttttgaggaatttagggtttttttgaaaaatggtttttggggtagtttttggaaattgattgtttttggttttttgtttttgatgtatatatatatagttggtgtttattttgaatttattattgtttttggttttgtatgttttgggtggataagggaaagatagaattatttggtttttttttgttgtttgtttagggttttagtattgaatgtagttttaaggatattatagaagtaggggtaattgaaggtatatggttaggggttaggaatagttgagggattttgaagagggatttttatttaaagtaaaattaggttgggtgtggtggtttatatttgtaattttagtattttgggaggttaaggtaggaggattatttgatttttaggagtttgagattagtttgggtaatatagtaagattttatttttattaaaaaaagaaaaaaaaaaattagttaggtgtggtggtgtgtttgtagttttaattgtttaggaggttgaggtgggaggattgtttgagtttgggagattgtagttatagtaagttattattgtgttattgtattttagtttggggaattgagtgagattttgttttaaaatataaaaaataaaaataggttgggtatgttggtttatgtttgtaattttagtattttgggaggttgaggtgggtggattatttgaggttaggagtttgagattagtttgattaatatggagaaattttgtttttattaaaaatataaaattagttaggtgtggtggtatatgtttgtaattttagttatttaggaggttgaggtaggagaattgtttaaatttgggaggtggaggttgtagtgaattgagattgtgttattgtattttagtttgggtaataagagtgaaatttggttttaaaaaaaaaaaaaattagtaaaattatattttaattgtatattttgattatagtattttagttgagttggagtgagggtttgttttggagaaggtagtttattttttttttttgttttggtatggggttatgatttattgtagggtgagaggagtggagagtggtgtatattagtagtttagttattagtggatagagtagtatttggagttagttttttatgttttatatatagtgagaaaaattattgtgatatgatgtttaattttgatttaagttgtataaaaggtagttttaggttaggttttaatttgttagaggtatataggtagttttttggtgggtttttgtatttgtttgtgttgtttggagatttggtttaaagattttttttttttttgagatgaagttttattttgttgtttaggttgtagtgtagtggttggattttggtttattgtaagttttgttttttgggtttaagtgatttttttgttttagatttttgagtagttgggattataggtgtgtgttataataatatttggttaatttttgtatttttagtagagatgggattttattatattggttaggttggttttgaatttttgattttaagtgatttgtttgtttttattttttaaagtgttgggattataggtgtgaattattgtatttgatttagagatttttaatttgattatttattttttattttatttagggattggatttttgttggaagggtggagtgtgggatagggtagttagggttttgaattgattttttttttttagatttttttggttttattgtattagttttattttttgttgatgttagataggttttagttagaatgtgagtgttatagatatagttaagtttagtgttgattaatattttgttttagaagaatttttataaggttttttgtagaatgattttgtgtttagtttaggagagttagggttttttttgattttgttttggagtttttttaagtatttaaattatttgatggggataaatggagaggatagatgagggagtagggtggagtgttttagtagaatgttttttatttagaatttgttgttattttgtagttagtaaggatgtggggttaagaattaaggttagggttttataggaaaaaggtaaagggggaggggtgggaatttaagtttatttttttttttaagtatttaaaggttttttggatggagaagagtattggagtaaaaattttagtataaattttattggggatagtgggtaattttgttgggttagtaaaaataaatggtgtgggttttggaaaatgagggttggaggttgtgaataaagtagtggatgtgtttgtttagtatattaatgggaagaagtatttagatgggaggagtattaggggtaggagaaatgttagatagattttagtgttagggtaagaaggaagattattttgtttgtagaatagggagggtatagggatggtgttaatttgtttttgtgatggttttgagtttttatttaataatgagaaagtttgtttttttttttttttttggatgatttaggagttttgggttgggatgtagtgattttatttttagtttttttttttttggtgatgaatttttttatttttatttagaaaatagatttggattagaggtattgtatagtttttttaggattttaaaggaggaagagtttttttttttgtttttaaagttgtttgttggaagaggattttaatagttattttagttggatgtatagtaggattatggaattttttttttgtattatagggatttattttttattttattattgtttataaaaattgatggttttttttttgagatagagttttgttttgttttttaggttggagtgtagtggtgtgattttggtttattgtaatttttgttttttgggtttaagtaattttttgttttagttttttaagtagttgggattataggtgtttgttattataattggttaattttttgtatttttagttgagatggggttttattattttggttaggttggttttgaatttttgattttatgatttatttattttggttttttaaagtgttgggattaaaggtgtgagttattgtatttggtttaaaattgatgtttttttttttttttttaatatataatttgggattttttagttttttattttttttttttttttttttttttttttgagatagagttttgtttttttatttaggttggaatgtagtggtttagttttgatttattgtaatttttgttttttgggtttaagtgatatttttgttttagtttttttagtagttgggattataggtatatattattatggttagataatttttttgtatttttagtatagatggggttttgttatgttggtttggtaggttttgaatttttggttttaagtgatttgtttgttttggttttttaaaatgttgagattataggtatgagttattaagtttagtttttttttttttttttgagatagagttttattttgttatttaggttggagtgtagtggtatgattttggtttattgtaatttttgttttttggttgaagtgatttagttttttaagtagttgggattatagttatatattattatgtttggttaatttttgtatgtttagtagagatagggttttattatgttggttaggttgattttgaatttttgattgtaaatgatttatttgttttggttttttaaagtattggtattagaggtgtgagttattgtatttggtttttttttttatttttgagatagagttttattttgttatttaggttggagtgtagtggtatgattttggtttattgtaatttttgttttttaggtttaagtgatttttttgttttatttttttaagtagttgggattataggtgtgtatttttgtggttagtttttttttttaattggttagtgttttgtggtttttttatttttttatagtggaaaatggtttaggattgattgatatgaagataagtttaggggtttatatttaatttaatttttgtatttaagttttgggttaagattttggtgtgttgagtattatttattttgtaaggaattttgtaaaattttatttgaagtattatttataattttattttttttatttaaataaggatttttgttttatttttgttaggtatattgagttttatagtttttgttttttttttttggtgtttaggtttggttttttgagtttggtggttatattaatggtatttggtatatagttttttgataatggggatatttaggaggttttgagatattttatagttttgggttagtaatttggatttttttttttatttttttaggtattttataatttagttttttttttttttgtgggtaaagtgtttttgaatgtttatggtttaaaataagattttttttttatttatttttaaatttttttttagatttattttagaggaagggaatagaattttttatattttagtagttggtgataggttagaatagggaagaggtgagggtttagttggttttatataggagtgtagatggaggagtaggatttttttttgttttttaagtttttttaaatatattttttaatttttggtgaggatttttttttttttatatttttttttagtttttttaaggagggagtaggagtatttgaatgtggaaattgaggtgttagtttaaattgtttggttggttttagttatagttggataatgtttggtttaggtttattataagttatatagttgttttttttgtgtttaatttgtttgtgatagaaattaagggggttttggtatttagtatttaggtggtggaattggggttttatgtatggttttgtgggtaggtttttggttaggatttgtggggagttatgtagttaggagggtggggttgtttattgatttaggatgtggtaatggattggggagggtggagttttagtgattgtttttttttttgtttgttggtattttttggtttttatttggttttggtgtggtttgtgagttagtgaggtttgtgtggtgaagtattgtttgagttttgagtttgagtttttttggttgtagtagttattgtttgttgtgttgttttaggttattttgaaagaaggtgtttttgttttgtttatagttgtatttgtttgttttttagttttgtgtgtttgtagttgttaattattgttttggttgtgtgtgtgtgtgtatgtgtgttagtgtgtgtgtgtgtttgggttagagttgtgttgtaattgttaagattgaaatgtagattgttgggatttagtttttgttttattggggtaggaatgttggggtggggatatgtatgttttgtttttaggaatgattttattgttttggagttttatttatagattttatttattatagggaatgggggtgggtgttagtgtttgggtaagtgtataagagtggtttttggttggaggtgagggtgggaaggtgtgggaagtgtgtgtgtgtggagtttgggttagtttgggtttgggtttgtttgtagtgggtggagtatttgtggagttggtaatttaggttttttttttagtttttgtgtagaattagtttttttgtgttgttgggaaattggtaattagaatgttttttgtgtgtggtatttaggtagtttttgagaatgtttgtattgtggtttgtttatttttgttttttttatatgtttttggttttgtgtttattatgtttgtgttttgttttattgtgggtttttagtttaggttttggggtttgtaatagtttaggtagatgagtgtgtggtagtggtagtggtaggtgaatttgtaatttgtagagaggtttggtggtgaggtggaggagttttaggttggggaaatgttttggagattgaagggaagttttagggagagggttgttgtttgttaggttttgtaggtttgatttattttagtgggttattttatattgttatgtggattttaatgttggttatttgggtgtttggaaattggttggaaggttataggtagagaggtttgtttaatagttggatttttattgtttagtatagaattttttttttttttattggtaattaaaaaaataataataaaaaattgtgttttgtttttgttatttaggttggagtgtaatggtgtgattttggtttattgtaatttttgttttttgggtttaagtgatttttttgttttagttttttgagtatttaggattataggtgtttgttattatgtttagttaatttttgtatttttagtagagatggggttttattatgttagttaggttggttttaaatttttgattttaggtgatttatttgttttggttttttaaagtgttgggattataggtttgagttattgtatttggttttttattgggaatgtatatggaatatatttgtttatttatttgaaggaaaaattaaatatttttaatttatgtttgttttgtggttgttatttgtttttattttttttagattaagatattggtttttatatattttaattttttgtttttatttttttttttatttattttagttaggtttgtttttttttttaggaaattgtttgggatagggtttttagtgatttgtgtattattaaatggaatttagtgttttattttttatttttatttttttagtattatttgaagtttgttttttttgatttttaggggttatatttttttagttttttttttattttttgtagtttttgtttagtttttttgtagattttgatttaatttttatattttatgatgaagtttgggtttagttttgattattggtttggtttgtttatatttatttgttttagatttatggttgaaatattgatttaaatttttagattagattttttgtgttagtatttttattaggatgtttaaaagatgttttaagtgaatatggttaaaatttaatttttttttttttagttttattgttatatttgtttagttttttttttgtagtaaaaatggttattaggtttttagttattggagataaaagtttaaatttatttttgattttttttttgtttttatttttgataaatatgtttaaattattttgttttttatttttatggttattttatttttttttgagaatgttgtaatgttttagttttgttttttttttttttttttttttttttgagatagagttttattttgttgttaaggttggagggtagtggtatgattttggtttattgtaatttttgttttttgtgtttaagtaatttttttattttagttttttgagtagttgggattataggtatttgttattatgtttggtttatttttttttattttttagtagatatgaggttttattatgttggttaggttggttttgaatttttgattttaggtgatttatttgtttttgttttttgaagtgttgggattataggtatgagttattgtgtttggttttttgtttattttttgtattttgttataattttgtgttttttttagttgaatttgtgatgtttttttgtattggatgagagggtttttatgtatatatagatttgggatattatttatttataagtttttaaataggttagagtagtgatgtttaatttagattttatgttataataatttggggagtttttaaaatttattgatgtttagggtttatttttagtagttgatttaataggtttgtggtgggatttaggttagtggggaggattgtaaaagtatttttggtgattttagttggtgtttatttaggggagagtaatttttgtttgttggtgatttttaggggtgtagaaggattgttgggtgtgtggttgtgtgtatattttagtatttgatttattgggttagaaaagggtgtttgttaaataaagatttaataaaatttttgtttgtagggggtttattaaaggttttaaatttttttaggtttttttttataggtggtaatttttttttattttaaaggttttggagggggttatgagtgtttgagaagaggtaagtttgggaagatggattttgaggatagtaggtataaatttttttttaagaagggttaaggtattttaaagataagaaatttaaaattagtgtatttttatatataagtagttatttttgtttatttgtggtttagatatgagtggagtgtgataagggataaattatttttgtgtattttttagtgatggggtgaaagtaatggatttagtttttgggagttgtttttgttgattttttttgttgtgatttgatttgtggtgattgtgttgttttttggttgttttttttgtttttgtaggtgtgtggggttattatttatgtgtgtattgtaggtttttgtgtatgatgttttagatgaagttgttatagaggttgtattatgtgtgtgtggtgggttttgtgggttggaagtggtggttatggttagggattagttgttgtgtggggttgtatgtggtgttttgtgtgatgtgtagtgtgttggtatgttttagttgggtgtggttttttttagtgtgtttagtgggtgttagtttttgtagtttaatgagtttaggtttttttgatatggtttggttgggtttgtgttttgttggttttgggtgttagtaagtgtgggttgggtggggttatagggtgggttttgattttagtgttttttttaggatttagattgggtggtgggaaggagttgaggagagttgtgtaatggaaatttgggtgtagggattgtggggtttgaaggtggggttgggtgtgtttttgtagagttttttttgttttgttttttttttttttttttgttttttttttatattttattttggatggttataatgatggtgattgtaaagtattatgtggagatatttgtgtttttggaggttagttttattgtgttagaggaagagggtttttatatttggttttggtttttttggtttggtttgttgaagtaatatatttggtttatttattgggtggggtaggaagttttgagtttttatttggggtgaggaggagggagattggttagtagttttattgtttgttttgttttttattgtggagattggggttttggtagaggttggattgtgattttgaggtttaggggtgtattttgggtggatttttttggtatgggtggttggtttttagtaattgtagtttttatttggttttgttattttgggttgttaggatataagtttttttatgttttttttagtgtttgatttggtattttttgtaggtaggtgggtattgaggatggtaatgtatgtgggggatgtgggagtagggtttagaggtttaaggttttaggatatttttatttgtagtaatattatttattttggtattgtgagtagtgtttagaagtttttgtattgtagtaagtatagtggggttgttttggagttattgtttttagtatatttagtttgtaggttttagtttatttgggggaaagttaggaaggtttgattggttttggaaggtgggggtattttatttatatttatgttttttgtattttttttattttttttgttatttttataggttttatttttgtgtttgtagttgtaggttttgttttgaggggttgaatatatgttggagttggtgtttggtaattgtttgttatttgtttttgtttttttgttttagttgtttttagatttttgggatttaggagagagaagtggagagtggtaggaaggtgttggtaaagtgggatagtggttttgagtagttaattttttagtgtttatttgttttaatattaggttttttttaggaggttgggttttagttagggttagatgggttaggaaattttgtaagtgggttaggttgggtagttggtttagtagtgtgtttgtgaggaaggtttgaagttgtaagggtgtttagtggaggttagtgtgatgtaggtgttggttagggggttaaggaaaaggaaggggttgggttgggttgagaatgtttgtgggggtttatgttttattagttggtgtgttatttgaggtttaaggattgaaaagagtattggggttgaggtgggtgggtaaagataaatagtagggatgtagttggggtaggatggggagggtggtattggggttgtgggggtt

SEQ ID NO: 639 - DNA, 2944 bp, Artificial Sequence
  chemically treated genomic DNA (Homo sapiens)
attttagttttttaagtagttgggattataggtatatgttattatatttagttaatttttgtatttttagtagagatagggttttgttatgttggttaggttggttttgaatttttgattttaggtgatttgtttattttggttttttaaagtgttgtgattataggtgtgagttattatgtttagttggaaataatgtttttaagaaaaattaaagtatattgtaaattgaatataaatagtaaattgagtagttgtattagaagagaataggtgagaaagtttattatggtggagttaataagttgtaagtttttggtataaagagaataagaaatataaaggtatggggggttgtataaaatgatagaaaatgttatttttgagatttgtgtgatatgttatgggtttttattagtttatttttagtgagatattttttttttataaaaaggggataaagtatattgttttgatttatagggtaaataaattataggttagttaagtgtatgaagttaaatggattagaatttaaatttgggttttattattaggtatattatttaattatttgatttagtatttttatttgataatattgattaatttataggattattgtaagattaaatatggtattgtttgaaaatttaaagtagaatgtttaatttataaaatgtttggtaagtggtagttgttattagtaaggattatagatgtatttttttgtgaattagatttagagtaaaagttttagaatttatttgtattagtaaggtttttttttataattaaggattattgattattaaattaaaatggtttttaaggaattaagtggagtttattttttttttaatttaaggttgtttttgtttattgtttaagtattttttggaagtagtaaggtttttatgggagtaatttttattgaatttatttgaaggttttgtaggttttataataaattttatttagttttgtattaggtatgttatagaattaatgaatttggagatgaagttaggttttttagtttagtttgtgaggaagataggtgatttgaattttaagaatgtaaaagatgggttgggtgtggtggtttatgtttgtaattttagtgttttgggaggttgaggtaggtagattatttgaggttgggaggttgagattagattgattaataatggagaaattttgtttttatttaaaaatgtaaagttagttgtgtgtggtggtttatgtttgtatttttagttatttgggaggttgaggtaggagaattatttgatttttggaggtggaagttgtggtgagtggagattgtgttattgtatattagtttgggttataagagtgaaattttgttttaaaaaaaaaagtaaaagatattattaagttttgtggagtaaggtattttatattttatgagtgagttaagatgggttttataattttttaagtaaggaaatgggtttggaggttttgaatatttgttatttaatagtagaatagttattggaattaaaattttttgattttaaataatagttttgtttattattattaagtgaagttatttataattatatattgattattttaagtttttgtaagattggtttgttttggggaataggttttgagagaatattttttttaaggttagaataaaggtattttataggttttaggttgtgttttgagggtgtttatttaaatatgagttggagtaaaaagaaagggatgggggatttggagtaggtataggggtggtttttttaagtagggtggtttgggatttttaagggttagtgagaagagaatatatattttagtttttgttttatttggttagatattgatggttgggatgtttgataaggaatttttttttgttatattgagaaatatttgtagtggtttatttaggtttgatttttgggtggtgtgtgtgttgtgtgttgtgttatggtgttatgtggttagtgtgggtttgtggtgtgagtttttgaaattaggtggtagaggtggagttgttgtggtattgttgtgtttttgttgtgttttgggtgttttttgtggtggtgggttgttgttgggagaagtgtgaggggatagatttgtgattggtgtggtttttgttagtttattttggttaaaaaagaattgtatttttggagtgggttagtggtggtggtagtgggttgggatgagtgtgttttttgtagttttagtttagtgtggtgggggagtgttttatgttttgggttgttgttgtggttttttgtttttttgtttttgttaatttttatttatgtttgagagaaaggtttttgtttgaaggtagatttttgttaagtaaatttgagttttgttttttttttgggtttttattttttgtttttggtttggtttttgggttttgtttttagtttaagatttaattttttttttagttgttttagatgatgttatttgaaattttttggaaatatgattattttaatggaatattgttgttttggggaagtgttttatagttgttgggtatgttgtatttgttttatttaagtttttggtaattgttgtattttgaagatatgttgatgggaattattaggtggtgttggtttttaattggagttttttgtttttattagttatgtgttattggttagtgtgattgaaattaaattgtatgaaaatttttttttttagttgtattagttatgttttgagtgtttaatgtggttagtggtattggtttggatagtatagttgtaaaatgtttttatttttatagtaagttgttattgttttaggagatgggattgaattagaatttaaataaattttttagtgtttttgagttttattttagttatataataaggaatgtatttttgtgtaagtgtattttggttttttgttttgtaga

SEQ ID NO: 640 - DNA, 2944 bp, Artificial Sequence
  chemically treated genomic DNA (Homo sapiens)
tttgtaaaatagaagattaaaatgtatttatatagggatgtattttttattatgtgattgaggtaaaatttagaagtgttggaaaatttgtttgaattttaatttagttttattttttggaatggtaatagtttattgtgaggatgggaatattttatagttgtgttgtttaaattggtgttattagttatattaagtatttgaaatgtggttagtgtgattagagaagaggatttttatatgatttagttttaattatgttaattagtgatgtgtggttagtggggatagagggttttagttagagattaatgttgtttggtaatttttattagtatgtttttggaatatagtaattattaggggtttaagtaaggtaaatatagtgtgtttagtagttgtaaaatatttttttaaaatagtaatattttgttaaagtgattgtgtttttaagaaattttagatggtgttatttgggatagttgggagggaagttaagttttgagttgaaggtggagtttaaaggttgggttggaggtgggaaatggagatttagggaaggggtggggtttgaatttgtttggtgaaaatttgtttttgggtaaggattttttttttaggtatgggtgggggttggtagagataaaagggtaagaagttgtggtagtgatttggggtgtgaggtgtttttttgttatgttggattgggattgtggaagatgtgtttgttttaatttattattattattattaatttgttttagaggtgtagtttttttttggttggagtaagttgataaaaattgtgttggttataaatttgtttttttatgttttttttggtggtgatttattgttgtaaaagatatttgaggtgtagtagaggtgtagtagtgttatagtggttttgtttttgttgtttagttttagaagtttgtgttataagtttgtgttggttatgtgatgttgtgatgtgatatgtagtatatgtattatttggaagttaggtttgggtgggttgttgtgggtattttttagtgtggtgaaaggaaattttttgttaggtattttaattgttagtatttgattgaataaagtgggagttggagtgtgtgttttttttttgttgatttttaagagttttaggttattttgtttggaggggttgtttttatgtttattttaagttttttatttttttttttttgttttagtttatgtttgggtgggtgtttttgggatatgatttgggatttatgaaatatttttgttttgattttaaaagggatgtttttttaagatttgttttttaaagtgagttgattttataaaagtttagagtggttggtgtgtggttgtggatgattttatttagtggtagtgggtggggttgttatttgaaattagaggattttagttttagtagttgttttgttattgggtagtaggtgtttaagatttttgagtttgtttttttgtttgaaaaattgtgaaatttattttaatttgtttatgaagtgtgaggtattttgttttgtagggtttggtagtattttttgtttttttttttgagatggagttttgtttttgtggtttgggttggtgtgtaatggtgtaatttttgtttattgtaatttttgtttttagggattaagtggtttttttgttttagttttttgagtagttgggaatataggtatgggttattatgtatggttaattttgtatttttaagtagagatggggtttttttgttgttggttagtttggttttaattttttgattttaggtgatttgtttgttttggttttttaaagtgttgggattataggtatgagttattatatttggtttattttttgtatttttaggatttggattatttgttttttttgtaggttgaattggaagatttgattttatttttgaatttgttggttttgtaatatgtttaatataaggttgaatagggtttgttgtaagatttataaaatttttaaatggatttagtgagagttgtttttatgggggttttgttgtttttagaaggtgtttgagtagtaaatagaagtaattttggattaggaaaagggtgggttttgtttggttttttagggattattttagtttgataattagtaatttttagttgtagaaggaggttttattaatgtagatagattttaaagtttttgttttaagtttaatttgtaaagaaatatgtttgtgatttttattaataatagttgttatttattaaatattttatgagttaggtattttgttttgggtttttaagtaatattatgtttaattttatagtaattttgtaaattggttagtattgttagatgaggatattgaattaagtagttaagtaatgtgtttggtagtaaggtttaggtttgaattttagtttatttgattttatatatttaattaatttgtgatttatttattttataaattagaataatatgttttgttttttttttgtgggggaggggtgttttattaggagtggattaatgagaatttgtggtatgttatataagttttagaaataatattttttgttattttatatagttttttatatttttatgttttttgttttttttgtattagggatttgtaatttattagttttattataatagatttttttatttatttttttttagtgtagttgtttaatttattatttgtatttaatttataatatgttttaattttttttaaaaatattatttttagttgggtatggtggtttatgtttgtaattatagtattttgggaggttaaggtgggtagattatttgaggttaggagtttgagattagtttggttaatatggtaaaattttgtttttattaaaaatataaaaattaattgggtgtggtggtatgtgtttgtaattttagttatttgggaggttgaggt

SEQ ID NO: 641 - DNA, 3862 bp, Artificial Sequence
  chemically treated genomic DNA (Homo sapiens)
atgggggggtgaagtttttttttggatttagagttggttgtgttggagtgggtgagtttttttatgttttgttgtttttagttgattttggtttgttttgtgttttgggttgggttagggtgtatgtggggtttggggttttttgttttatgggatgggagaggttgggtgatagttttgggttttataaattatttaggtggttgttgggttgggattttatgaatgaaaaagtagttgggttgtttttgtgtgtgggttgatgttatgaggtttggttatgtgggggttaatgtgattgtgggtgtttggggagtgggggggggtatgattgtaggtgttttttgttggggtaatttattgttttttatgtggaatttgggggtaattatttttttaggatttggaatattagtaattttaatttttggtgggggagggggtgtgggaggaatttattttgaaaggtgggggtggggggggttgtattttgttgtgagtattttggtgaaggggagagggttttttttattagttttttttgagtttttattgttaagagggtatggtggtttgatgatattgaattatatttaaaaggaagtaaatgaatagtttttttaatttggggtaggtattgtaaaaataaaaataaaagttaagatagtaaaatgtttttttattttttaatgtattaaagagatagaatttgtaattttaaaaattgtgtattttaatttatatttgtttaagtttgtgataatattggggatttttttatgtaattatgaatatttattgattttgttaaaaattagattagtatatttgtttgtttaattgataattgttttgaattatgttggtttttgttagtttttttatgtttatgaatttagttttagggtaaattttaaaggtgaagggatgtttatatttttaataaaattaattaggaatttttggtggttttgttttaggtagaggggattaatatttttagtaatttaattttttttttaattaaaaaaaatgagttagaatggagattattgttttttagttttttatttagaggtgtgttttttttggttaaattgttggtatgggaagggagggggtgtagttggggatttttgtaaggattgattggttaaggtaggaaggtagtttgaagagtttttaggttagaaggataagatgaaggaaatgttggttattattttgggttgttgttggaatttttgggtatttattttattttattttttgagtgagtgtatgttaagttgaaatttttttaatttttaggggttatttttttgggtatttgtaatgatgtttttgtgtgttggaatgaaatttgtataggggttgtgtgtttggttttttttgtttttgtatgttaaattagtttttgtaatttatatgtgttaatgaaaatgaaagaagatgtagttgttgagattttttggttgtttgtttgtttgtgggtgtttttgtggtgtttttggaaatgtgtttattttgttggtttggatatggggtgttgttgtgttttagttatttttttttgtggtttttttaggttgtgtgtggtttgttggtttttttagttgttttttattgtagagttatttttattttattttttaaattttgggggatttatttgaggtggatggggttttttgtattttttttttttggtggggagaaaggttgtagtggggtgatttgtatttttatgaaaattggattataggggtaattttgttgtagggtaggtgtggtgttttagggatggtttttgggttttgttttttgttgtttttggtgtttggtgtttgtgttttttttttttgtgtttgtttttgttttttttttgtttttattttttgttgggttttgatttttgtttaataatagtaatgttatatggattataggggagttttgttgaagttgtaaagttttggagtttttagagggttgttggtgtagtagtagtgagtagtagagtttgtatgttttggtgaggggtagaagagtgtgagggagtgtggggtagtagaagtgagagttgagtgtggatttagttaggatttatagttttttttagttgtttaggaagagttttagttatggaatattagtttttgtgttgtgaagtggaaattatttgttgtgtgtattttgatgttaatttttttaatgattgggtgttgtgggttatgttgaaggtggaggagatttgtgtgtttttggtgtgttattttaaatgtgtgtagaaggaggtgttgttgtttatgtggaagattgttgttatttggatgttggaggtgtggggttgggggtggtttttttaagatttttttgtaatttgttgtttagatttatgtttttttgttatttatttttttttttttttttttgttagaattttgaagtttgttgtggtgtttttagggatttgtatttttaaaataaaaattgtgggtattttttgaaggaggaaggggtgggggtgggggtgttagaagtagtgttttgtgggaggggagaagggggtttgggaggggtgtttttgggagaagttagtgttaggggtattttaatgggtttgagggtgtgggttggtaggttgggtgtgttttgtgttttttgtttgtgttttagtttggttgtgttttagtggttgggagttgttaattttggggggagggggtatagatttgatttttaaattaatatttatggatatgtatgtaagggttgtttgtgttagtattatgtgttatttttgtttttttattgtaaagtaaaagtgtttattaataattgggggtagggtgggggtggggagtggttgttgggtgttggggttgtagttaagggttgtgtggttgttgggagtttgtgggaggggtgtagggatgtggtatgggtagttttggggggatgttgttagggaagggggggtttttgtttaagtagtgagttttggggtgttttgaatgggtagtttgggttggagagtatggtgagttgtaaggttgtgtggtttttaagatgttagggtttgatttttgtttgtagggatattggtttggaggattttttttgagtgagttgggggtttgggagtatatttttagatttttggtgggtgtttgaggggtttgtaagtattttaaaataatttttgaaagtgtggtgtggtgtttttgtgagagggaaatgttgtttgtgtttagggggaagggggggttttggagtttgaatttttggggttttttttggagtttgtaatgaatttttaatttttggtttgggtaaagggttgtttgagggttatttttagggtttttttatgtatttagttatttttttaatatttttaaatattttttgaaaagatgatgtttggggaaatgtggtgtggtggtttgggatgttatttttgtgttttgtaggtgtggtgtttaattttgtggtttgttttgtggttttgtattttagttggtgttgatttttagttagagggattatggagttttagggtgggttagggttttgggggttggtagtttgtgttgttgtgtatgttgtttagttgtgtttgtttttgtttttattgtgttagttttgtggggatttttttttttagttttggggagggtgggtattggggatgtgtgggggagggggtgtattatgggaagtttttgttgtttttagttttgattttttggtgttttttagatttggtggttttgttaagtgtgatggggggtgtgggggtgtgtgggggggtggtgtgatttggtggtggtggttatgggttttgtgtttttgtagg

SEQ ID NO: 642 - DNA, 3862 bp, Artificial Sequence
  chemically treated genomic DNA (Homo sapiens)
tttatggaggtatggggtttgtgattgttgttgttaggttgtgttgtttttttgtatgtttttgtattttttattgtgtttggtagggttgttaggtttggagggtgttgaggggttggggttgggggtggtaggagttttttgtgatgtgtttttttttttgtgtgtttttagtatttattttttttgaaattgaaagggaaagtttttgtgaggttggtatggtgggggtgggagtgggtatagttgggtggtgtgtgtggtggtgtgggttgttggtttttgggattttggtttgttttggagttttgtggtttttttgattgggggttgatattaattggggtgtggggttgtggaatgggttgtggggttgggtgttgtgtttgtgagatataaaggtggtgttttaggttgttgtgttgtatttttttagatgttatttttttaaaaaatatttaaaaatattaaaaaaataattaagtgtataaaaaaattttgaaaatgatttttgggtgattttttatttaggttgggggttgggagtttgttataggttttggggggagttttaggaatttaaattttggggtttttttttttttttgggtgtgggtggtgttttttttttgtaagggtattatgttgtatttttaaaaattattttaaaatatttgtgggttttttaggtgtttattgaaggtttgaaaatgtgtttttaggtttttggtttgtttggagaaggttttttaagttgatatttttgtagatggggattaagttttggtgttttgggggttatgtgattttgtagtttgttgtgttttttggtttaggttgtttgtttggggtgttttgggatttgttgtttgaataaaggtttttttttttttagtggtgtttttttaaaattatttatgttgtgtttttgtgttttttttgtgggtttttggtagttgtgtggtttttagttgtggttttagtgtttggtggttgttttttgtttttattttgtttttaattattaataaatatttttgttttgtaataaaagagtaaagatggtgtataatattggtatgagtggtttttgtatatgtgtttatggatattaatttaaaaattaaatttatgttttttttttttggagttggtggtttttggttgttgaggtgtagttgggttggggtgtaggtgggggatataaagtgtatttagtttgttagtttgtatttttgggtttattggggtgtttttggtattggttttttttgaaggtattttttttggatttttttttttttttttatgaaatgttatttttagtatttttatttttattttttttttttttagaaaatatttgtaatttttattttgaaaatatggatttttagaaatattatggtaaattttaaagttttagtgggagagaagggaggggggtgagtagtaaagaaatgtgggtttgggtaataagttgtagggaagttttaagagagttgtttttagttttgtatttttagtatttaggtggtgatgattttttgtatggatggtagtatttttttttgtatatatttaaagtagtatattgagggtgtgtaggttttttttgtttttagtatggtttgtagtatttggttgttgaggaggttggtattggggtatgtgtggtggatggtttttattttgtagtataggagttggtgttttatggttggggttttttttgggtagttggggagggttgtgggttttggttgggtttgtgtttggtttttgtttttgttgttttgtgtttttttgtgtttttttgttttttgttggagtgtgtggattttgttgtttgttgttattgtgttgatagttttttggaggttttaggattttgtaattttaataaaatttttttgtagtttgtgtgatgttattgttgttaagtaaagattaaagtttggtagagaatgggagtgggaggggggtgggggtgggtgtagggggagggggtgtgggtgttaaatgttgggagtagtgaggggtagagtttaaaagttatttttgaggtgttgtgtttgttttgtggtggagttgtttttgtagtttggtttttatagaaatgtaaattgttttgttgtagtttttttttttgttagggaagaggggtgtagggggttttgtttgttttgagtgggttttttgggatttagggggtgaggtggaggtggttttgtagtaggggataattaggaaggttggtaggttatatgtagtttggggagattatgagaaggggtgattggggtgtggtgatattttatatttaagttggtagaatgggtgtatttttaagaatgttatgagggtatttatgggtggatagatggttaaagaattttagtgattgtatttttttttatttttattaatatgtgtaaattgtaagaattaatttagtatgtaaggatggggaggattgggtatataatttttgtgtaagttttattttggtgtataggggtgttgttgtaaatgtttaagggggtaatttttaaaagttaaagggattttagtttagtatgtgtttgtttaaaaaataaaataaaataaatgtttgaaaattttagtagtagtttaagatggtggttagtattttttttattttgtttttttagtttggagattttttgggttgtttttttattttgattagttggtttttgtgggggtttttaattgtattttttttttttttgtgttggtaatttaattgggagaaatatatttttgaatggaaagttgagaaatagtgatttttattttgatttattttttttaattaaaaaagaaattaaattgttggaaatattagttttttttgtttgggataagattattgaaggtttttaattggttttgttgggggtgtagatgtttttttatttttagaatttgttttgggattgaatttgtgagtgtgagggggttggtaggagttggtataatttagaataattattaattaaataaatgagtgtattgatttgatttttagtaaaattgataggtgtttgtggttatatgagagggtttttaatattattgtaaatttaagtagatgtaaattaaaatatatagtttttaaaattataggttttgtttttttggtgtattaaaaaataaaaggatattttattgttttaatttttgtttttatttttatagtatttgttttaaattaagaaaattgtttatttatttttttttgaatatagtttagtgttattaaattattgtatttttttaatagtaaaagtttaaagaaaattgatagaaaaagtttttttttttttgttagggtgtttatagtaagatgtgattttttttatttttattttttagggtgaattttttttgtgtttttttttttgttgggaattaggattattaatattttgggttttgggggggtaattatttttggattttgtatggggagtgatgggttgttttagtagggagtatttatggttgtgtttttttttattttttgagtatttataattgtgttggtttttgtatagttaagttttatagtattagtttgtgtataagggtggtttagttgtttttttatttataaaattttgatttggtggttgtttggatgatttatggggtttggagttattatttggttttttttattttgtggggtgaggggttttgagttttgtgtgtgttttggtttagtttgaggtgtgaagtgggttgaagttggttaggggtagtagggtataaagaggtttgtttattttggtataattggttttgggtttaggagggagttttatttttttat

SEQ ID NO: 643 - DNA, 2358 bp, Artificial Sequence
  chemically treated genomic DNA (Homo sapiens)
ttattaagggattggtgggagggggaaataggaagttgttgtttaatgtgtataaatttatagttatataatatgagtgagttttagaaatttgttgaataatttagtgattatagttaataataagattttgtgaatttaaaaatttaaagagagtagattttatgtgaagtgttgttattataaaaataaaataatgggatataaggaaaatttggaggtaatggatatgtttattatttggtttgtagtaatgataatgtgagtgtatgtatatatttgtttaaatttattaaattgtgaatattaattatatgtagttttttggatattagttgtattttaataaagttgagggggaaagtgatattattgtaaataaataatttggttttatgatgggtggagaaattattttagagagtgtattagggaagatttttttaaggagaagatttgagaaggaagtgaggattttaataaagtgagagattaatataggtagataattaggatagattattttagtttgggagaggtgggaatgggggaagaagtttagtaagaagaagtttttgagaaaaggtttagtatggtatgttttaggatttgtaaagaggttggtataggtggatatgagtgggggtagggtaagaaaggaagttggagagtttattagaatggattatttagggttttgtaggtaatggtaatgagttagaaatgtatttggtgtttattttttaaattatatttggaaatatatatgaattttatttagttattgggagatattggaaagttttaagtaggggaatgatttgaattgatttagatttgtatttggttttgttggttagggtgtggagaattgattatagatatagtaagagtgtagggagatattttagaatattttttgttttttttggttatgtagatttggatattttttggataaggtatgaatattttattttagtagtttattgtttgttttttttttatttattttgtttaatttaaatttaagattttgttatttttttgttgtattaatttaagttgttttttgttaatggagagtaatttatatatttatagttgatttatatttattggagtttatttaagggaggatattattttttatattgttttatgtttaatttttgtttttgaagaaagaataagtaaaaattaaaaggtagaaatgaaatttattggtagatagtttggtgttatattttgggtttggtagttaaagattgatttttgatttaattggttatgttatttatagattttagatattgtatggaaaagtattgtgaaaatttttgttttgttttgttttgatttgattattagtgtatgtagtttttagttatgtatttgttgtttgtttaattaattataatttttttatgtagatttttttagagttgtgagtttttaaaagggataggaattgtttatttagagagtttagtttttgagataggagttttgttgatgtttttggttgaataaattttttttttttttaatttggtatttgaggaattttgtttgtagtttgttttgttatattttttggttttttgattgggaagtgaggtgattggtggatggttgaggtagttttttaggtgatttaagtttgttttgtggaatattttggtgggggattttggttagtttgagtaatgtggattttgagagtatttttaggtaggtatttgttttggtgggatgttttgttagagtagtgtgtggtaggtttttgtggaggattaatatagtggttgaatattgggaaggaattggtatttggagtttggatatttgaaatttggtaagattagtttttggaatttgtttattttatttgagtagaagtgtggtttgtttatttatggtgtgtttttattggtattttggttttggttttggttttgatttggtttgaattgtttgataggattggttttgggaatttgtttattttatttgagtggaagtatggtttgattattgatggtgtgtttgtattggtattttggtttttgtttttgatttgatttggattgtttgatattttggttttgtttttgatttggtttgaatttttggatattttgattttggttttgatttttgtttggtgtaaattgtaaaagtgtgtgtgtgttttttttattggttttttgttttgtggtgtgtatgtggtgtgagtgtggtgttttgttttaaagaagtatgggttaggtataaataagtttattttattaggaattatgttgaaaaattttaaaaagggatttaagggagattatgatattaggaaaatttaga

SEQ ID NO: 644 - DNA, 2358 bp, Artificial Sequence
  chemically treated genomic DNA (Homo sapiens)
tttaagtttttttggtgttatagttttttttaaatttttttttgaaattttttaatatagtttttagtagggtgggtttatttgtgtttgatttatgtttttttgaggtaaaatattatgtttatattatatgtatattataaaataaagaattggtaaaaagggtatatatatatttttatagtttatattaaataaaaattaaaattaaaattagagtatttagaaatttaagttaagttaaagataaaattaaagtattaagtaatttaagttaaattaaaaatagaaattaaagtgttggtataggtatattattggtgattaggttatgtttttatttaaatggagtaggtaagtttttaagattagttttgttaagtaatttaaattaagttaaaattaaaattaaaattaaagtgttaataaaggtatattgtgggtgagtaagttatgtttttatttaaatggagtgggtaagttttaaagattagttttattaagttttagatgtttagattttaagtattagtttttttttagtgtttagttattgtgttgattttttatgggggtttgttatatattgttttggtaaggtgttttattggggtaaatgtttatttgggagtgtttttaggatttatgttgtttgggttggttagagttttttattggaatgttttatagggtaggtttaagttatttaaggagttgttttgattatttattaattattttattttttagttagggaattaggaaatgtagtaggataagttgtagataaaattttttggatattgaattaaagaaagaagaggtttatttggttagaagtattggtaagatttttgttttaagagttgagttttttgagtgagtaatttttattttttttaagggtttatagttttaagggggtttgtgtgaaagggttgtgattgattgagtaagtagtaggtatataattgggggttgtatgtattggtaattagattagaatagaataggataggaatttttatagtgtttttttatataatgtttggaatttatagataatataattggttaggttaggggttgatttttaattattagatttagggtgtggtattagattgtttgttagtggattttatttttgttttttagtttttatttattttttttttagaggtagaaattgggtataagataatatgaggggtggtatttttttttaaatggattttaataaatgtaagttagttgtgggtgtatggattgttttttattagtagggagtagtttaggttgatgtagtagaaaggtggtagagttttaggtttgagttaggtaagatagatgaggaaaaggtagatagtgaattgttaagatggaatgtttgtgttttatttgagaaatgtttaagtttgtataattaggagagatagaggatgttttgagatgtttttttgtatttttgttatgtttatagttaattttttatattttagttagtaagattaaatgtaagtttaagttaatttaagttatttttttgtttaagattttttaatgttttttagtagttgaataaagtttatatatatttttaaatataatttggaagataaatattaaatatatttttaatttattgttattgtttataaggttttaaatgatttattttggtaagttttttaatttttttttttattttgtttttatttatgtttatttatattagtttttttgtagattttgaaatatgttatgttgaatttttttttagggatttttttttgttgaatttttttttttatttttattttttttagattgaaatgatttattttagttgtttgtttgtattgattttttattttattagggtttttattttttttttaagttttttttttggagaagttttttttagtatattttttaaaatagtttttttatttgttatgaggttaaattatttgtttatagtaatattatttttttttttagttttattgaggtatagttagtatttaaaaagttgtatgtaattaatgtttatagtttggtgggtttggataagtgtatatatatatttatgttattattattataagttaggtaataaatatatttattatttttaaattttttttgtgttttattgttttgtttttatggtaataatgttttatatgagatttattttttttaagtttttaagtttataaaattttattgttaattatagttattgggttgtttagtagatttttggaatttatttatgttgtataattgtaaatttatatatattgaataataattttttattttttttttttattaattttttggtaa

SEQ ID NO: 645 - DNA, 2501 bp, Artificial Sequence
  chemically treated genomic DNA (Homo sapiens)
ttgtattaaaagtttaaaggagaaatttaaattttatatagatgttttatgaagatgtttagtaaatttatttttttttgttttttggaatttattttagtattgtgttatgtgtgtgtttagtaattttttataaaaagttttgttttttgtgatgttattagattatattgaagaatatataagttgtattatgaaggttgttgttttatatagttttaatgtagtgagaattgatgtttttatatgttgtttttttgggtatttaaagaaatttttgtatagttttataaattagttgtagtttaaattgatttgtgttgtgatttgtatatataggttatatttttttgatagaaaatatagtttaaaattaaatttgtagtttttgttaagtgaatgtataggattttattgtatttaggttttttattgtaagatttatttttgtttttattttatgttttattgttgtgttttttatttgtttttttttagttttgttttttgtgtttttatggattgtttttagtttaggtgtgtaggaagtatatatatgtttgtagagtttttatggtttttgtatttagggtatgattttaatgtatagtggttgtattgatttgttaaaataaaggaatagattattttttttaatttatagggaagttttaggttgtgtgggtagtgagtagatttgtgtttgtttgtgtttgttttggtgaaaaattttattgtttaggttgtagggtgtgagatttaggtataaatattttgttggatgaggaggaaagatgtaaggttgtttttttttagagatagtaaagggtaggtttgtagttttatttattttaggattgtgatttttgatagagttgagagattagggttgttgaattaggtttgaaggttttagtgaattttgtgaagagaggaggggtttggttgtaatatggatttagaggatatttttattgtaggagaaggaatagtggggatggggtggatttgttaaaggaatatagtttaagtttttgtagtttaaaaaagtttagttttttttggttaaagtttttgtgagtttttttggtattttttttgtgggagttataggggtagtgggatatttagtttttttaaaagtatttttatggttgtttgtgttaagtttttattttaagagttttatttttgtgaagtaatgtgttttatatattggttttaaagtatttatggttggttgtaataaatattaaggaggtttgtttttgtatttggagttgggtgtttttattttagatgattttgagggtgtttgataagatttgaaggatttttggattttagagtattattttggatgtttggtatttttgttgtgtgggtatggtgatttttttagttgttaggttagtttttgatttttgagagggttttgtagtgttgtaggggaggtggggatttgaataaaggagtagtttttttgttggtgttattatttgatgttggttttaaggtttggttagtttgtttaaagttggtataagtttgttttgtaaaataaaagaagggaaagggggaaggggattttggtatagatttggtttgatttggatataggttgggtttgtaagtttgtggggattgggtttagaggggtagtgttgggaatgttttttttggaaattaattttttagggtatttgttttttttttatgtgttgttttatttttgttggagattaggttttgtgggggttattgttgtttattgtttttggtggttgttggttttgggtttttgttgttggttttttttttttttttttgtatttttttttttttttgttttttttgattttttttttgttgtttggttttttttttttttgttttgtttttttgtgttttggtttgtgtgagttagatgtttgggtagtttttggtgtagtgtggttgtagtagtttttgttttttgtatggtgtgagtgtttgatgtggttgaggtggttggagttttgagttagttttggtggttgttgttgtttagattggatgataggttattttgttggtgtttgtttgagtttttgttttgttgttaatgttataattattgtgtatggttttttgattttgtttagtattgattgggagagttggagtgagttttttggggagtagtgatgtgattttttgggatggttggggtagtgtttttggtgttgttggttgtgttttgtttggtgagttgggttttggaggaaaagaaaggtaagggtgtgttttgttggtttttgtgttgtttttggattgtgttttggattttgtagtttgtttaattgtgtattggtgtattggtttggtgtttgtgtttttgtttgtttttttttgtttttttgagattagttgtgttgttgattgggattgtgggaggaatgggatgttttgttttttggttgggagagtttggggtgggtggaggaggagatgtgtgggat

SEQ ID NO: 646 - DNA, 2501 bp, Artificial Sequence
  chemically treated genomic DNA (Homo sapiens)
gttttatgtgtttttttttttgtttgttttagatttttttggttgaagaatgaaatgttttgttttttttgtggttttggttggtggtgtagttgattttaaggaaataggaaaggatgggtgggggtgtgggtgttgagttggtgtgttggtgtgtggttgggtgggttgtggggtttggggtgtgatttgggggtggtgtgggagttggtgagatatgtttttatttttttttttttttagagtttgatttgttgggtagagtgtagttagtagtgttaggagtgttgttttggttgttttggagggttgtattgttgttttttgaagagtttgttttggtttttttgattaatattggatggagttagggggttgtgtgtggtggttgtggtgttggtggtgaggtggggatttgggtggatgttgatgaggtggtttgttgtttggtttgggtggtggtggttgttggggttagtttgggattttggttgttttggttgtgttgggtgtttatattgtgtggggggtggaggttgttgtggttgtgttgtgttgggggttgtttggatgtttagtttgtgtgggttgaggtgtggggaggtagggtgggaggaggagggattaggtggtggaggagggattgggaggagtagaggaggaggagaatgtgaggaggagggaggagaattagtagtggggatttaaggttagtggttgttggaggtggtggatagtggtggtttttgtgggatttagtttttggtgggagtggggtggtgtatgggaggggagtgggtgttttgaggagttaatttttgagaggggtgtttttagtattgtttttttggatttggtttttgtggatttgtaggtttagtttatgtttaggttgagttaaatttgtgttagggtttttttttttttttttttttttttgttttataaagtaaatttgtattagttttagatagattggttgagttttagagttagtgttggataatggtattgatggggaaattgtttttttatttgggtttttattttttttgtagtattatgggatttttttggggattagaggttggtttggtagttgaggaggttgttgtgtttgtgtggtaggggtgttaggtgtttgaggtggtgttttaaagtttgagggttttttagattttgttaagtatttttgaaattatttgaaatgagggtatttaattttgggtgtagagataggtttttttaatgtttattgtaattagttatgggtattttgaagttaatgtgtgaagtatattattttgtaaaagtgaagtttttggaataaaggtttgatataaatagttgtggaggtgtttttagagaggttaagtgttttattgtttttgtagtttttgtaggagaaatgttagggaaatttgtggaagttttggttaaaagaaattgagtttttttgggttgtaggaatttgagttatatttttttggtaagtttattttatttttattgtttttttttttgtagtaaaaatgttttttaggtttatgttatagttagattttttttttttttatgagatttattaggatttttaggtttggtttaataattttgattttttggttttgttaaaaattataattttgaagtaagtgaagttatagatttgttttttgttgtttttgaaggggagtaattttatattttttttttttatttagtaaaatgtttgtgtttgggttttgtattttgtagtttgaatggtggggttttttattagggtaagtgtagatagatataggtttgtttattgtttgtataatttggaatttttttgtgaattaggagaagtaatttgtttttttgttttaataaattagtatagttattgtgtgttgaagttatgttttgaatgtagaggttatgaaggttttgtaggtatgtgtgtgttttttgtatatttgggttgagagtagtttgtagaaatatagaaaataaaattagagaaaggtaaatgggaagtataatagtggaatataaaatgaagataggagtgagttttataataaaagatttgaatataataaagttttgtgtatttatttaataagggttgtaaatttggttttaaattatattttttgttaagggaatgtgatttgtgtgtataagttataatataaattaatttaagttataattgatttgtaagattgtataggaatttttttgagtgtttaaaaagatagtatgtaagaatattagtttttattatgttaggattatatgagataatagtttttatagtatggtttgtatattttttaatgtgatttgatagtattataagaaatagagttttttgtaaagaattattagatatatatatagtataatattgggatggattttagggaatagagaagaatgggtttgttgaatatttttatgggatatttatgtaaagtttgagttttttttttgagtttttgatataa

SEQ ID NO: 647 - DNA, 3647 bp, Artificial Sequence
  chemically treated genomic DNA (Homo sapiens)
tatggtttagtttttagtttagttttgtgattttgggaaagtttttttagtttgtggaattttaaggtttaaggttttttttttgtaaaatggggaatgataatatttgttttttttggagttttggggatttagtgttttgaggaatgtggttgtaggttagagtggtatagagtagggtttaatgaagtatggtgtttatagtagtttttttgattggattaatttttttggatataatagtagggtaggggtggggtttggggagaaaggatatttttaattttgattttaatattttgatggtttttaaggttgtttgtatatttatttaggtgtaagttttttaaggtgtggtgtgatgaattagtgatttttggagttaggttagtgtattttttttttgtagggttgtaagttgtaggattgagaggtaggttgattaggttttgggttggatgatggggtgagagtaaggggttagttttgatatatgtttaatttttttttttagttttaagatattttgggtaaattgtttattttagtttttttgatttttattttaattttaatattagtttaagagaaaatagggatattgatggttatttagaagggttgttgtgttttatatatagtaatattttttgaatgtttgtgatagtggtttaaggaataagttaattttatattattattttggatatttgtataaaattttattttatttttattatatgaatgtgttagggttgtttttttgttttgttttttttttttttttttgagatagagttttgtttttgttgtttaggttggagtataatggtgtgattttggtttattgtaatttttgttttttaggtttaagtgatttatttgttttagtttttttgagtagttgggattataggatgtgttattatgtttggttaattttgtgtttttagtagagatagggtttttttatgttggttaggttggtattaaatttttgattttaggtgatttatttgttttggttttttaaagtgttgtaattataggtatgagttattgtatttagttgtgttagggtttttttttgtttaatttttttttttttttttagtttttttttgtttgttttaatggagttttattttgttatttaggttggagtgtagtggtaagatttagtttattgtaatttttgttttttgagtttaagtaatttttttgttttagttttttgagtagttgggattataggtgtttgttattatatttagttaatttttgtatttttagtagagatggggttttgttatgttggttaggttggttttgaatttttgattttgtgatttgtttgttttggttttttaaagtgttgggattataggtatgagttgttatatttggttaatttttgtattatttttttaaagagagttttttaaattatataagttttaggttttataaaatttagatttgttttagtataattaaatttgggattatttattgagtaattattatgtgttaagtattgtgttgagtgtttttagagtattattttttttaattttagtatagtatgttagatgttgttttatagatgagttaattgagattagagatgtttagttatttgtttaaggtgatatgattgatatggaatagagttaagatttttttttttttttttgatatggagttttattttgttttttaggttggagtgtagaggtgtaattttagtttattgtaagttttgttttttaggtttatgtatttttttgttttagttttttgagtagttgggattataggtatttgttattatatttggttaattttttgtatttttagtagagatagggttttattgtgttagttaggatggttttgattttttgattttgtgatttgtttgttttggttttttaaagtgatggaattataggtgtgagttattgtgattggttagatttaagatttgaatttaggtttttttggttttagaggtttttgttttttaattttttagtatgtatatgtatttgtttttttagaggtgtttgtttaagtgtgtttagtatatggaagtaagttagaaatgttaggtatatttgtaaagaggtgtgggagatgggggggagggaagagagaaagagatgttggtgttttttattttttagtttttgataggtgtttttgatttttttttgattagtatagttgtatttttggttggggtattttaattagaattgttaaatttagtatataaaaataaggaggtttagttaaatttgaattttagataaataatgaataatttgttagtataaatatgttttatgtaatattttgttgaaattaaaaaaaaaaaaaaaagttttttttttatttttatttttattattaggtttaaggaatagggttaggggttttaaatagaatgtggttgagaagtggaattaagtaggttaatagaaggtaaggggtaaagaagaaattttgaatgtattgggtgttgggtgtttttttaaataagtaagaagggtgtattttgaagaattgagatagaagtttttttgggttgggtgtagttgtttgtggttgtaattttagtattttgggaggttgaggtgggaggattatttgagtttgggagtttaagattagttttattaatgtggagaaattttgtttttattaaaaatataaaaaatttagttggttatggtggtatatgtttgtaattttagttgtttgggaggttgaggtaggagaattatttgaattagggaggtagaggttgtggtgagtagagattgtgttattgttttttagtttgggtaataagagtaaaagtttgtttaaaaaaaaaaaaaagtttttttgatgtgattgtttttttttaaatttgtagatttttttaagattatgttttttagatattttaaagattttagaagatatgttttgggggttttggaagttataaggtaaatataatatatttttttttttgattattaattttattagaggatgtggtgggaaaattattatttgatattaaaataataggtttgggatggagtaggatgtaagttttttaggaagttagataattgagatttaaagggtgttaagagtggtagtttagggaaatttattttggattttgggggagggggtagagttattagtttttgtatttagggattttttgaggaaaagtgtgagaatggttgtaggtaatttaggtgttttggtgttaggagggatgatttaggtttgtgtgaagagagggagaaagtgaagttgggagttgttgatttttagattttgttggaatgtagttggagggggtgagttgggagtgtgtttgtttttaattattggagaaggaggaggtggaggaggagggttgtttgaggaagtataagaatgaagttgtgaagttgagatttttttttattgggattggagaaattaggggagttttttgggtagttgtgtgtttttttttatggggttttttattgtgttgtgtgtttggtttttattttttgtagtattttgtgttttgtgtttttttagttgggtttagttggagttatggggttggagttgtagtgagtatt

SEQ ID NO: 648 - DNA, 3647 bp, Artificial Sequence
  chemically treated genomic DNA (Homo sapiens)
ggtgtttattgtggttttggttttatggttttggttggatttggttgggagggtgtggggtgtggggtgttgtgaggggtgggggttgggtgtgtggtgtagtaaagggttttgtgggaaggggtgtgtggttgtttggggggtttttttggtttttttggttttaatggaggggaattttagttttataattttatttttatatttttttaagtagttttttttttttattttttttttttttggtgattgggagtaagtgtgtttttagtttgttttttttaattgtattttaatgaagtttgggagttggtaatttttagttttattttttttttttttttgtgtaggtttgggttgttttttttagtgttgggatgtttgggttgtttgtagttgtttttatatttttttttggagaatttttaaatgtagaggttggtgattttgtttttttttttggagtttgggataaatttttttaggttgttatttttaatattttttaagttttagttatttaattttttggggagtttgtattttattttattttaagtttattgttttaatattaaataatggtttttttattatattttttagtaaaattgatagttaaggagggggatgtgttgtgtttattttgtggtttttaggatttttggggtatattttttggaatttttgaagtatttgaaaagtatgattttaagagggtttataaatttgggaggagatagttatattgaaaggatttttttttttttttaaatgaatttttgtttttgttgtttaggttggagagtaatggtgtgatttttgtttattataatttttgtttttttggtttaagtgatttttttgttttagttttttgagtagttgggattataggtatgtgttattatgattagttgaattttttgtatttttagtaaagatagggtttttttatgttggtgaggttggttttgaatttttaagtttaggtgatttttttgttttagttttttaaagtgttggaattataattatgagtaattgtatttagtttaaaaagatttttattttaattttttaaaatgtattttttttgtttatttaaggaggtatttagtatttaatgtatttaaggttttttttttgttttttgttttttattagtttgtttaattttattttttaattatattttatttggagtttttgattttattttttaggtttagtggtaggggtggggatggaaggaagatttttttttttttttttaattttaataagatattgtatgggatatatttatattaataaattatttattgtttatttgaaatttaaatttaattgggtttttttatttttatgtgttaaatttggtagttttagttggaatgttttagttaagaatgtagttatattggttaagaagggattaaaggtatttattagggattggagaatgaaggatattagtatttttttttttttttttttttttttattttttatatttttttataggtatatttagtatttttaatttgtttttatgtgttgagtatatttaagtaggtatttttagagggataggtgtgtatgtatgttagggagttgagaaataggggtttttgggattaagaggatttgggtttaaattttgaatttggttagttgtggtggtttatatttgtaattttattattttgggaggttgaggtaggtagattatgaggttaggagattgagattattttggttaatatggtgaaattttgtttttgttaaaaatataaaaaattagttaggtgtggtggtgggtgtttgtagttttagttatttaggaggttgaggtaggagaatgtgtgaatttgggaggtagagtttgtagtgagttgagattgtgtttttgtattttagtttgggagatagagtgagattttgtgttaaaaaaaaaaaaaaaaattttgattttattttatattagttatgttattttgggtaagtgattgagtatttttggttttagttggtttatttgtaaaatagtatttgatatattatgttggggttaaaggagataatgttttggaagtatttagtgtaatatttggtatataataattgtttaataaatggttttagatttagttatattggggtagatttaggttttgtggggtttgaagtttatataatttgggaaattttttttaagaaagtaatataaaagttggttgagtatggtggtttatgtttgtaattttagtattttgggaggttaagataggtagattatgaggttaggagtttgagattagtttggttaatatgataaaattttatttttattaaaagtataaaaattaattaggtgtggtggtaggtatttgtaattttagttatttgggaggttgaggtaggagaattgtttgaatttagagggtagaggttgtagtgagttgagttttgttattgtattttagtttgggtgatagagtaagattttattgaaataaataaagagaggttaaagagagagaaaggaattgaatagaaaaagattttagtatggttgggtgtggtggtttatgtttgtaattgtagtattttgggaggttaaggtaggtggattatttgaggttgggagtttggtattagtttgattaatatggagaaattttgtttttattaaaaatataaaattagttgggtatggtggtgtattttgtaattttagttatttgggaaggttgaggtaggtgaattgtttgaatttgggaagtggaggttgtggtgagttaagattgtgttattgtattttagtttgggtaataagagtgaaattttgttttaaaaaaaaaaaaaaaaaataaaataaaaaaataattttagtatatttatatagtaaggataaggtggagttttgtataggtatttagagtgataatgtaaaattaatttattttttggattgttgttataaatatttgagaaatattgttgtgtatggaatatagtagtttttttggatggttattaatatttttatttttttttgagttggtgttagggttagggtgaggattaggggaattgaggtaagtaatttgtttaggatgttttagggttagagagaaaagttgggtatgtattaaaattgattttttatttttattttattatttagtttaggatttggttaatttgttttttagttttgtagtttatagttttgtgggaagaggatgtgttgatttggttttaggagttattggtttattatattatattttggagggtttgtatttggatgagtgtgtaggtagttttagaggttattgggatgttaggattagggttagaggtgttttttttttttaggttttatttttgttttgttgttgtgtttggaaaggttagtttagttaggaaagttattgtggatgttatgttttattggattttattttgtgttattttgatttatagttatgttttttagaatattgagtttttaagattttagaggaggtaggtgttattattttttattttgtagaagaggaattttgagttttgagattttatgagttaaaggaatttttttaaggttatagagttgagttgggaattgagttatg

SEQ ID NO: 649 - DNA, 3050 bp, Artificial Sequence
  chemically treated genomic DNA (Homo sapiens)
atgtgtgtttttttgtttttttttttttttatgagtgagaaaaaaaagtgtttaaatttttattaatataaattaatgatatataatgatgaaattttgtttttatttttgtttgtgatagggaatgtaaaaatagtaagtggtttagttttatgaatttttgttttttgttttttttgtttttgttgggttggatttttaagaatggaggttagtgtatagttttgtgtgggttgtttagtttttggatttggtggatgatgttaggtgatgggagtggttgtggttgggttggggaggttgtggtttaggggagttgggagggagggtggttttgttaggttgatggtgtgtttggttgtgtggtgttgtttggagatggttttggtggtgttgtgttgttgtaaatagttgtttttttgttattatttatagtaggattttttggtttttgggtgtggtggttggaggtaggtttgtggtttggttttttgtgtgttttgaattatttgtttgttggttttattttgttttgtttttttttaggtgtttattgtgggttttgatttttgggtttgaagagtggagaagggaagattggggttgtgtggggatatgtgtttttgtgttttggaggtggttagtgtgttggggttgagttttggtagtgtgattttggttgttttatgtagtagggtaggagattggggggtgtggtatattttggagtattttgtttttttaaagttttgtgttttaggatgtggagttgtttttggggttttagtagttgaggtattttgtttaggtgtagttggatattgtttttttagtttttgttttttattttttaagtttgtgttggaaaattatttgttgtgggtttttgtaagtatagttttttggtgggattgaattagtttttagtgtagatttgagttttttgtaggaagtatattttgttttgttattttgaattgattattttgtttatataattatattttgtattttttatttttggggtttagtttagaattgggtagatattttttttaaatgtttttgtatgtaggttttgtatagtgtttatttgttggtgttttagggatttgatagtttttttaatatttttatatatggttgagaaaaataaataaataaatgtgttgttttttttaaaaaaataaataaataaagtatttagtattgtaaagtaggttattgtatttttttattttggattttttattttttgtttttaaatgtaggaatagtgttagtattgtttgagtttgagggttggaggttaggggatgaaggtttgtttttatgttttgtattgaattagggttagaattggggatgggggtaggggtgtatttttttgggagttgaggtttaagtttttggggttttgtatttgatgttgttttttttatttttgagttttagaattgtttttagtttttgtataagggtaaaaaggtgttttttgttttattttttttgattttgggaataagggtttgtattgaattaggtgtgaatgtttttttttattttgtgttgtttttgtttttttttttttagttgtggtttttgtttttttttgtattgtatttttggtgttggttgtagtttgtgagtagtttttgttaatttttttttttttatataggatgtttatattaggatatttgtgttagtaggtttttatggtttttttttgtagttttggggggagttatttttgaaattttttattttggggggtttatgagatttttgagataggaattgtgaaatgtttatgagattaggatatgtgttaaggtgggggtagggagttgtgagtgttggggatgtagttgggtggttgtagaagtgtttaggtttgtgtgttatttttttggtgttattgtggttgagtttgtgatgtttatatttatttataaaatgtttgttataaaagtagtggttgtggtgttttgtattttaattgtatttgtagtgagtatttgagaagttaagattgagttggtggttgtggtgtagtgaatgagtagtgattgtgtttttatttagttttgttttatagtgtttatttgtttttgttttttggttttttgtttggttttgtttaattgttatgatgatgtttttgggttttaatgtagattatgaggtgttatttttttgttgtagtagtgtgtttttggttggggatagttttttttattattatttatttgtagattttttttttagtatgggtttgtttgttaatgtgtaggtaaggttggttttttgttgttgtggggttgggggtttggggttgtggaggaggagatattgggtgggatgttttagtagatgagtagggggtttttttgtgtttggagggaggttgttgtggttggagtggtgttggtttgggggtttgggatttgttttgagtgtatgtatgtttgttatagtaagaattggttttttttttgggaggtaggtttgttttgagtaatttttggtttgtattttaggatggatttttgatattagttggagtagatgtgttttaagtataaatttgttaattagagtttggtttttttggggaggtggtagaaagtggtaatttttttttttttggtagtttggagtatggaggagggatgagggaggagggtgtagtgggtgggtgtgtaaggtagttttattgataaaaagtgagtttattttggagattttggagtggtgtttgtgttagtgtagatgttagggatatttataataaatttttttttaagtaagtgatgttgaagggataatgggaatgtagtggtaggatggaagagataggtattgtgttgtggaatgtttgggaggaaaagggggagattttttatttaggatgagggatatttaagatgaaatgtttgtggtaggattgtttttttttattgttgtatgtggtattgggaatttgttttatttgtgtttggaatttgtttgtttatgttggttttttttttttgttttgttttagg

SEQ ID NO: 650 - DNA, 3050 bp, Artificial Sequence
  chemically treated genomic DNA (Homo sapiens)
tttagaataaaatagaaggggaaagttgatgtgagtgagtaggttttggatataggtggggtgagtttttagtgttgtatgtagtagtgaagagaaatgattttgttatggatattttattttaaatgttttttattttggatgaaaggttttttttttttttttttaggtattttgtagtgtagtgtttgttttttttattttgttgttgtgtttttgttatttttttagtattatttgtttgaaagggggtttgttataaatatttttgatgtttgtgttgatgtaggtgttgttttggagtttttagaatgaatttgttttttattaatgaaattgttttatatatttgtttgttgtattttttttttttattttttttttgtgttttaggttgttgggggaggggggattgttgttttttgttatttttttggagaagttaggttttagttagtgagtttgtgtttgggatatgtttgttttagttaatgttagagatttgttttggagtgtagattagaggttgtttagaatgaatttgttttttgaagggggaattaatttttattatggtaagtgtgtgtgtgtttagagtaagttttgagtttttgagttggtattgttttggttatggtagtttttttttaggtataagggagttttttatttatttattggagtgttttgtttggtgtttttttttttgtgattttaagtttttggttttgtggtgatgggaagttagttttatttgtgtgttgataggtgagtttatgttggagaaggagtttgtgggtgagtggtagtaagagaggttatttttggttggggatgtgttgttgtagtgggaggatgatgttttgtagtttgtgttgaagtttgagaatattattgtggtggttaggtaaagttgggtgaggggttgaggggtggagataggtgggtgttgtggagtagagttgggtaggagtatggttattgtttgtttgttgtgttgtggttgttggtttagttttggttttttagatgtttgttgtagatgtggttggagtatgaggtgttgtagttattgtttttataataagtgttttatgaatgagtgtaaatgttatgggtttaattatggtggtgttagaggggtggtgtgtgggtttgggtgtttttgtggttgtttggttgtgtttttagtgtttgtagttttttgtttttgttttggtgtgtgttttaattttgtgagtattttgtagtttttgttttagaggttttgtgggttttttaagatgaggggttttggggatggttttttttagggttatagggaaaggttgtggaaatttgttgatgtagatgttttaatatggatattttgtgtaaggggggagggattgatgggaattgtttgtgggttgtagttaatattgagggtgtagtgtggggggaggtgggggttgtggttgggggaggggaggtgggaatggtgtagaatgagagagaatatttgtatttggtttaatgtggatttttgtttttgaggttgggggggatggggtagagagtgtttttttatttttgtatggaaattgaagatagttttgaggtttagagataggagaaatggtattgagtataggattttgaggatttaagttttggtttttgaaggaatgtgtttttatttttatttttaattttagttttaatttagtgtaaagtgtggaagtagatttttattttttaatttttagtttttgggtttgagtaatattagtattgtttttgtgtttggaagtagaaagtggaggatttaaaataagagaatatgataatttattttatgatattgggtattttatttatttatttttttaaagaagatagtgtatttatttatttattttttttggttatgtgtgggaatattaaggaaattgttaaatttttgagatattagtagataaatattgtgtaaaatttatgtgtgaagatatttgaagggggtgtttgtttggttttgagttgggttttaggggtagggagtgtgaggtgtggttatgtgggtagggtggttagtttgggatgataaggtggggtgtgttttttgtggggaatttaaatttgtgttgagggttggtttggttttgttaggaagttgtgtttatgggagtttgtagtgggtgattttttagtgtggatttggagggtggaggatgggggttggaaggatagtgtttagttgtgtttgggtggaatattttgattgttgggattttaggagtggttttatgttttggaatatggggttttggggaggtaaggtgttttagagtgtgttatgttttttaattttttgttttgttgtgtaggatagttggggttatgttgttggggtttagttttagtgtgttggttatttttagggtgtgaagatgtatgtttttgtatagttttggtttttttttttttattttttgggtttgggggttggggtttgtggtgggtatttggagaggggtgaggtaggatgaggttggtgggtggatagtttggggtgtgtggggagttggattgtagatttgtttttagttgttgtgtttgggagttaggagattttgttatagatagtaatagggaagtggttgtttatagtaatatagtgttgttagggttgtttttaggtaatgttgtgtggttgggtgtgttgttggtttggtgaggttatttttttttttagtttttttgggttgtggtttttttggtttggttgtggttgtttttgttgtttgatattatttgttgggtttgggggttgagtggtttgtgtgaggttgtgtgttaatttttatttttagagatttaatttggtaggagtggggagggtaggaggtggggatttgtggaattgggttatttgttatttttgtattttttgttataggtagaggtgaaaatagaattttattattgtatgttattggtttatgttggtgggaatttaggtgttttttttttttatttataaaaagggagggaaatggaaaaatatatat

SEQ ID NO: 651 - DNA, 3397 bp, Artificial Sequence
  chemically treated genomic DNA (Homo sapiens)
gttgtaagttgtttagttggtggtaaatttttatagtagttttaggaaaatatgtttgtttaatattttattttgaattttaagtttattttatggaattattttgagtttggagtttgatttaattttttttagtaattaatgttttttattttttatttttaaatatgttatattggttttatttttataataattgtatttatttattttttggtaatggggttgttattttttgtagaatgaaaagtagagtgtgtatgtttatattttttttttttttttttttttttttttttttttttttttttttttttttagagtattgttttgttttgtttaggttggagtgtagtggtgtaattttggtttattgtaatttttgtttttagggtttaagtgatttttttgttttagtttttggagtagttgggattataggtgtttgttattatgtttggttaatttttttgtattgttagtagagatggggttttattatattggttaggttggttttaaatttttgattttaggggatttatttgttttggttttttaaagtgttgggattataggtgtgagttattgtatttggtttatagaattttttaaaaagttattgtgtttagtttttatggattttttaaattttagttgtttagttttttggagttaaatgagattatttaaaggttgattgttggggtttttaaggttgttttggagatttattttataggtaattaaatggattgttgggtttttgtgtgtgtgggttttttttgtttattttttttttttagaaaaatattttattaagaaggtttttataatttattggaggaggaggatggagagtgggtatgaaaggattaggatgaatatgttataagtaatttaaatgttattgtaatattgtttggtgaggatttgattattgatgttttaaagttaagtttttagttgttattttatttagtagtgaaataatgagttttaaaatatatattttggtttaagtttttttatgtggggaggtaatttatttgaaggtatttttagtttgtatttaatatagtgtttagtattaaagtagtttagatgttagtgaatggtggttattgggaggtttgttagtgggtgttagtagtggtttttttagagaaaaagaaaatttttttttgttagattagtattttatgagttgtgaattaaaattattgttattattattattataattttatttatagtaattattataaaggtttaataatgttttgtagatgaatattttgagtaattgttttataattaggagatttaagattgtattaaaaattagtagagggttatattttattgggtataagttgtttatgataatgaaattgtagtttaatttgtgaagagatgtgaatgtaattgagatatgtttaaatggaatatatagatgagttttatttttatatttggtatgtttggatttatgttgattttttagttgtttgggtttgtttttaggggttatggattgtatgattttattagtggtattgttattgttgttgtttttgtgttgtttgtgttttttgattattgattgggtttggtaggtgttttttgggggtttttttattggttttagtttttgggatttgggagtgttttgttaggaagttagagttttgtaggggttgtggtgtttaggttgtttaatgtgtgttttttgtttggtgttttgaagtggttttgaggggtgggagttgaggtgagtggtaaggttgggttgggggtgtatagtgtttttagaagtgtgggttttttttatttttggtagtgattttattttttgtttttgttgtgtgtgtgtgtgtgtttgtttgtttgtatgtttttttgatgttagtgggaatttttagttaggaagtgagagagtgagtgagatagaaagagagagaagtgtattagtgagttggggtaggaagaggaggttttgttattggagtggtttggtgatgtgttgatagttttttttgttttttttgttggttgggttgttagttgttgtagtttttggtttgtatgtagttattggttttgtttttggagtttagtgttgttgaggttgtagttgtttggttagtaaggtggtgttgttgtttggttattgtgtgttttgtgtttttttttgtttgtgttgtggttatggtgtggtgttgattggtttggtttggttttgttgtgtttttgtttgttttgatttgtatttgggtttgtttgggttttggtttgttgttgttttttttttttttagttggtaggtttgtgttgtttaggagggagagtttatttgtgttaggaggttgaatgtggatttgttatttgggtaagttaaatttgggtgagtgggggtttggtaggggatgtgtggtttaagttttgttgtttagttttttgtattttttttagttttatttggatttttttatttttgtgttaattgttgggttagattgtgggaggaggttgatagtagttgagaggtatatgggattagtgatagtggggaaagatatatttggattttgtaggggttagttggttgaagggttgtggttgtttggtggttatttttttttatgtttttttgtggggtgggaatgtgaattggaggggaatttttataaatttttaaaatttttaattttagttttatttgggggatggtgagaaggttggagtgtgttgtggtgtggaggagagagggaaggtggttggtgtagtgtagaattagattttatttaagggtgttttatgaaatgaaagtagaagtgtttgttagtttttttggttgggaaagttttttttagttttttagaattgaataggagagtttatttattttttttttatttttaaaagaaatttggtttgttttttgttttttttttttttttttttttttttttttgtgtgtgtgtgtgtgtgtatatatatatatatatatatatatatatatatatatgatatagttatttgttataggatttgattttgattttttggggtttggtatttgagagagaaaataaattatttatttggatatttagagtattttttagatttgattatgtaaaatttttggatagtgttattatgtattatgtatgattgttgaaataaaaataatgtaaaaataaggtttattttaaatgtaagtttttttatggtttttaaaaatagatattagggaatgtttgttttgatttgttggtttattttgaaatttaaatgggatttaatgatataggatttaattattaagattgatatgtttatggattttgttaagtagaggtttttagtattatagtttatgaaataatta

SEQ ID NO: 652 - DNA, 3397 bp, Artificial Sequence
  chemically treated genomic DNA (Homo sapiens)
tggttattttataaattgtaatgttgaaaatttttatttaataaagtttatgaatatgttaattttgataattaaattttgtattattaagttttatttgagttttaggataaattagtaagttagggtaaatattttttggtgtttgtttttaaggattatagaaaaatttgtatttaggataggttttgtttttatattatttttgttttagtggttatgtataatgtatggtggtattgtttaagagttttatataattaagtttaaaaagtgttttaagtatttaggtaggtaatttatttttttttttaaatgttaggttttggaggattagaattaagttttatagtaggtgattatattgtgtgtgtgtgtgtgtgtgtgtgtgtgtgtgtgtgtgtgtgtgtgtgtgtgtatggagggggggaggggggagagagagagagatagagagtgagttaggttttttttagaagtaggagagggatgaatagatttttttatttaattttggggagttggggagggtttttttagttaagaggattgataagtatttttgtttttattttatggaatgtttttaggtgaaatttggttttgtattgtattaattatttttttttttttttttgtgttgtagtgtattttaatttttttattattttttaggtggggttggggttggggattttaaaagtttgtaagagtttttttttggtttgtgtttttgttttgtggagggatgtgaagagaaatgattgttgggtggttgtggttttttggttgattagtttttgtgaggtttggatgtgtttttttttgttgttgttaattttatgtgttttttagttattgttaatttttttttatggtttagtttagtggttagtgtaggaatgaggaagtttgagtggggttggagggggtgtggagggttgggtggtaggatttgggttatgtgttttttgttgggtttttatttgtttgagtttggtttatttgggtggtgagtttgtgtttggttttttggtgtgggtgggtttttttttttaagtggtgtgggtttgttggttggagaaggaagaggtggtggtaggttggagtttgggtgggtttgagtgtgggttggggtgagtgggagtgtggtggggttgggttaggttagttagtgttgtgttatggttgtagtgtgggtggagggaagtgtagggtgtgtggtggttgggtggtggtgttgttttattggttgggtggttgtggttttggtggtgttgggttttgggagtggggttggtggttgtgtgtaggttgagggttgtggtggttggtggtttgattgatgggaagggtaggggaagttgttagtgtgttgttgggttgttttggtggtgaaattttttttttttgttttggtttgttggtgtatttttttttttttttgttttgtttatttttttattttttggttggaaatttttattgatgttgagagagtatatagatagatggatatatgtgtgtatgtagtgggggtgggaggtagggttgttgttgggggtgggggaagtttgtatttttaggggtgttgtgtgtttttggtttggttttgttgtttgttttggtttttgttttttggggttgttttggggtgttgggtgaggggtgtgtgttaggtggtttggatgttgtggtttttgtggggttttggttttttagtagggtgtttttgaattttaagggttggagttggtagggaagtttttaggaagtgtttgttgggtttaattaatggttggggaatgtaggtagtatggaggtggtggtggtggtagtgttgttgatagagttatgtggtttatagtttttaagggtaggtttgagtagttggagggttggtatggatttaagtatgttagatataaaaataaagtttatttgtatattttatttaagtgtgttttagttatatttatatttttttatagattaaattataattttgttattataaatgatttgtgtttagtaaagtataattttttattggtttttggtgtggttttaaattttttggttatagagtagttatttagaatgtttatttataaggtattgttaggtttttatgataattattgtggatagaattatagtgatggtggtagtaatggttttggtttatagtttataaaatattgatttggtagaggggagttttttttttttttgaagagattgttattggtatttattgataggttttttagtggttattatttattggtatttgagttgttttagtgttgggtattgtattaggtataggttggggatatttttgggtggattatttttttatataagaaagtttgagttgaaatatatattttagagtttattgttttattattgggtggagtgataattgaaagtttagttttaaaatattagtaattaggtttttattaggtaatattgtagtggtatttagattgtttatggtatgtttattttagtttttttgtgtttattttttattttttttttttagtaggttataaaaatttttttggtggagtgtttttttggaaaaaaaaaataaataaaaaaaatttatatatataaaaatttagtgatttatttgattgtttatgaggtgagtttttgaggtgattttggaggttttaatagttgatttttaagtgattttatttagttttgggaggttgagtagttggaatttagaggatttataaagattgaatataatgattttttaagaaattttgtgagttgggtgtggtggtttatatttgtaattttagtattttgggaggttaaggtgggtggattttttgaggttaggagtttgagattagtttgattaatatggtgaaattttatttttattaataatataaaaaaattagttgggtgtggtggtgggtgtttgtaattttagttattttagaggttgaggtaggagaattgtttgaattttggaggtagaggttgtagtgagttaagattgtgttattgtattttagtttgggtgagatagagtgatattttgagaaagaaagaaagagagagggagggagagagggagggagggagggaggtgtgagtatatatattttattttttattttgtaaggggtggtagttttattattaaaagatagataaatataattgttataagagtagagttagtgtgatatatttgggagtaaaaaatgaagagtgttaattattgaaaaggattaaattaaattttaaatttaaaatgattttataaaatgaatttaaaatttagggtagggtgttgagtaggtatatttttttggggttgttgtaaaaatttattattgattgaatagtttataat

SEQ ID NO: 653 - DNA, 5087 bp, Artificial Sequence; identical to SEQ ID NO: 593
  chemically treated genomic DNA (Homo sapiens)

SEQ ID NO: 654 - DNA, 5087 bp, Artificial Sequence; identical to SEQ ID NO: 594
  chemically treated genomic DNA (Homo sapiens)

SEQ ID NO: 655 - DNA, 12963 bp, Artificial Sequence
  chemically treated genomic DNA (Homo sapiens)
gttaggagttttagaaataggggagagttagaaagttggttagatttatgttttttaagtgtagggttagggttgagtttgtttttggggtaggtaagtttttttgaatttttgagggaagtagaagatataaattgttagataaaatgtaagtttagtttaaaagggttatgtgttgttttttttagttttggggtattttttttttagaaaattggattgttttatagtgaaaattttgggggtggttagttttttgttttgttgttatttttattatttatagttttttaagaagtttttaggttgggtgttgaattttgattaggaattattgagaaattgaggtagttgggagaagttgtagttttaagtgttgaaaggaagatgggggataataaatttgggttgttaagtaaagggggtagaggtttggagaagtgggttttaggattagaggatagattgattttatattttatttttttagattttatattttattgttattattatttatgtgttttttttgttttttgtagtgggttttttagaggtattttttatggtttttttagattttaattttggtttgtttgttttttttttagaaaggtttttgtttgttttttttgtaggaaggtttgtatttttagaaagtttttgttttttgatttgaggatttaatttattaggggaattaaattttgtttttaggggagtggagagagaaattgggttttttttttgtagtttttgggatatagttgagttagttataggatttggggataattggggtggatttttttttttgggaggtggtggtattagtttagagtttgtatttttatttattggggaagtgtggggagaaggatgggttggagttgggttttggtttgaaggatagtagtttggagttaatggttgagtttttaaagtttttatattgtagaggaagtatagtggagattagttttagttaggatggttttgaagtttttagggatttgatgtagagttaaagaaatttatttgtgtttttttttttttttgggagtaggtagaagatttttgggaggagaggtgaatagtggatgttaatttttttgaaagtattgtgttttttagtattgtgggttgttatgggttttttgttgttgtgggattttggtttattttttgattgggttgttgtattttggattagattttgtgggtgatttatggaatttgtggagttgggatgtgaaaggttagaaggttttttgtttttattaagttttagggttttttgtggttgttgggagttgtagtttgaatgtttttattttggtgagaagtgtttatgttttttttattgagttttgtggtaatttttaaagtatttgtattgtttttttgttgtttgtagagggtgtagtaggttttgtattttttttgtattttattttttaggttttagatttgttttttttatttaaaaaatatttattattgagtttttatttgttatttagtattgatataggtatttaggaatataataatgaataagatagtagaaaaattttatatttttataaggtttatgtttttatgtattgaaagtaatgaataaataaattttattagagtgataagggttgtgaaggagattaaataagatggtgtgatataaagtatttgggagaaaatgttagggtgtgatattatggaaagtttttttaaaaaatgatattttaattgatgagaagaaaggatttagttgagagtaaatgtaaaagtttttttttttttattttttatatttgatataatgtaggatttttttaaaatgatttttattaattttgtttttatagttttggtttgtagaattttttattttaaaatgttagtatttatggtattaggttggtgagaattttgattttgtatttttttttttaattttattttttttgttttttttggtaggtggattatttgtttttatttgttatggtgattgtttagttttgtgttaggagttttgtaggggttgatgggattggggttttttttttttatgtgtttaagattggtgttaaaagttttgagttttttaaaagtttagagttattgtttagggagtaggtagttgttgggttttggggatattttgtgtttgggttgggagtgtgttttttatgatggtgatatgtttttttggattgggtaagtttttgattgaatttgatgagttttttttgagttatgggtttttggttttgtgtatttttagtttgggaaaattgttggggttgggggtggggtagtggggatttagtgagtttgggggtgagtgggatggaagtttggttagagggattattataggagttgtattgttgggagatttgggtgtagatgatggggatgttaggattatttgaatttaaagttgaatgtttaggtagaggagtggagttttggggaattttgagttggtttaaagtgtatttttttgtatatttatttggtgttgggtgtagggaatttttgaaataaaagatgtataaagtattgaggtttgagatttttggattttgaaatattgagaatttatagttgtatattttagagtttatggtattttagtgaaaattggggttttattttgaaatgattatttgggggtgatttggggagtttaagttgttaaggttttataatttttggatttttgttttttttggagtgatttttttaggtagtttttggttttgttagatggagaaaatttaattgaaggttgttagttgtggaagtgagaagtgttaaattaggggtttgtttgttaggttgaggaggattgttgtaatttgagaggtttggtagttttgttattgtttggttttatatttatatttttgttttttgtagtagtatttttggtttttttttgttggagtagtttattatttatttgatgagaggggaggagagagagagaaaatgttttttaggttggttttttttatttggtagagggaggttgttattttttgtttgtatttttttttttggattatttagttatggtttttgtaaaggtaggggtatttgttttgatgtaaattttaatttttttttttttttgaatggtgtgttttattttttgggttgtttgtaatttaggtggatgttattatggtgtagatagggagggaaagaagtgtgtagaaggtaagtttggaggtatttttaagaatgagtatattttatttttttggagaaaaaaaaaaaagaatggtatgtttgagaatgaaattttgaaagagtgtaatgatgggttgtttgataatttgttgggaaaaataatttatttgttatttagttttgggttaggttattttagttttagatgtaggttgaatgttgtgaagtggaaggggtgggtttgtaggtgtttgtgtggttttttgtgtagtttttggtttgagttggttttttttggtaggaggtggaatttgaatttattttttttgttgttttattttttagtttgtggttgttttattttgtagtttttttttatgtatttgttgtgtattggttattttgtgttgtatttatgttattttttttttaaattgaggtggtatttatatatagtgttagtgtatatagtaagtgtataggaagatgagttttggtttttaattgttttgtgatgtttattaagttatagattttttttattgttttagaaatgttttattatgtttttttttagttgatttttgattttatttttattttgatttttataattattttgtttgttggagaattttatatagaatggaattaggatgggtgttgtggtttatgtttgtattttggtttatgtttgtattttgggaggttgaggtgggtggattatttgaggataggagttttagattagtgtggttaatgtggtgaatttttgtttttattaaaaaatataaaaattagttgggtgtggtgggtgtttgtaattttagttatttgggagggtgaggtaggagaattgtttgaatttgggaggtagaggttgtagtgagttaagattgtgttattatattttagtttgggtgataagaatgaaattttgttttaaaaaaaaggggggaattatatattatgtgtttatttttgttgggtttttgttttttaatgtattgtttgatatttgtttatgttgtatatattagtattttgtttttttttatttagtatagtttattgattgtatatttgtttttttgatggttttttgagttgttttttatttgtggttatgaaataaagttgttataaatatttttgtataattttttttgtgattatatgtttttgtgttttttggagaaatatttaggaggggaattgtggaggaagtaaaaagtagttgtattttgaatttttttagaagttttgagttttttagagtggttgtattattttatattttaattagtaaggtatgggagttattatggttgtgttatagttttttggatattaggtatgttagtttttttaatgtggtatatttttgtggttgtaatttatagttttttattgattaaggatgtttagtatttttttatgtgtttattggttatttgtattttgtttgtaaagtagttttttgagttttttatttgttattttggtttttttgtttgtttttattgtttagttgtgggattgttttatattttttggatataagtttttattagatttatgagttgtgaatgtttttttttgatttgttgtgggtttatttgtttgttttatagagtttatagaattttaagaggagtggattaattttttttatgtttagtatttgttttgttttgtttaggatatttttttttttttttttaattttagggttatgaagatataattttatatttttttttaggatttttatggtggtaagttttatagtaaggtttttaagttattaattaatttttaaaattaattgtttatggtgtgaggtgtaggagttagtttttggtattttttttgtatggaaatttagttattttgtttttatttgttgaaataggttttttttttttattgaatgtttttaattttaattattttatagttggagtatagggttattattttagtgttattttttttttttttttgttaatttttgagatagggatttatattgttgtttaggttagagtataatggtataattaaggtttattgtagttttgaatttttgggtttaagtagttttttagtagttttatgagtagttgggattattttattatatttagttaattattttatttttttgtattgataggattttattatgttgtttaggttggttttaaattgttggttttaagtttttattttattttggttttttaaagtgttgggattataggtgtgagttattatgtttgattttttagtgttattttttatttattttttttgttttttgttttttttaaatgttggaggaagaaatagtatttattttatataaattttttagaaaatagaggaatagattgggtgtggtggtttatatttgtaattttagtattttggtatgttgaggtaggggattatttgaggttgggagtttgagattagtttggttaatatggtgaaattttatttttattaaaatataaaagtagttaggtgtgtattatatttgtaatgttagttatttaggaggttgaggtataagaattttttgaatttgggaagtggaggttgtagtgagttgagattgtgttattgtattttagtttgggtaatagagtgagattttgttttagaaaaaaaaagaaagaaagaaaaaatagaggaatattttttaatttgtttttgaagttaggataattttggtattaaaattaaataaggatattataagaaaagaaaatatagattaatatttttgttagtatagatatgtaatagttaattaattttagtaaattaaatttggtaatatagaaaaaaggataaataggttagttgtggtggtttatgtttgtaattttagtattttgggaggttgaggtaggtagattatttgaggttaggagtttgagattagtttgattaatatggtgaaattttgtttttaataaaaatataaaaattaggttgggtatggtggtttatgtttgtaattttagtattttgggaggttgaggtgggtagattatgaggttaggagtttaagattagtttgattaatgtggtgaaatgttatttttattaaaaatatgaaaattagttggtgtggtggtatttgtttgtaattttagttatttaggaggttgaggtagaattgtttgaatttgggaggtagaggttgtagtgagttaagattgtgttattgtattttagtttgggtgatagagtaagattttattttaaaaaaaaaaaaaattagttgggtatggtggtgggtatttgaaattttagttatttgggagtttgaggtaggagaattgtttgaatttaggaggtagaagttgtattgagttgggattatattattgtattttagtttgggtaatagagtgagattttattttaaaaaaagaaaaagaaaaaggataaatatattttaattaaataatgtttattttatgattgtagttgatttaatatttaaaaattggtttggtgtagtagtttaggtttgtaattttaatattttaggaggttgaggtaggaagattttttgagtttaggattttaagattagtttgggtaatatagttagattggtttttattggggggaaaaaaattagtttgtgtaatttattatattaataaagggaaatataaaaattttatgattattttaatagatgtagtaaaagtagttaatgatattaatatatatgtatgattataaattaattaattttttagtaaattagggaaaggaaatttaattagtttgataatagggtgtttatagttggagttttattagtagtatatataatggtagaaaatttagtgttgttgggggtggtggtttatgtttgtaatgttagtgttttgggaggtttaggtgggtggattatgaggttaggagattgagattgttttgattagtatgttgaaattttgtttttattaaaaatataaaaataaaaaattagttgggtatggtggtgggtgtttatagtgttagttatttgggaggttgaggtgagagaatggtgtgaatttgggaggtggagtttgtagagtttagattgtgttattgtattttagtttgggtgatagagtgagattttgttttaaaaaaaaaaaaaaaaaaaaaagaaaagaaaatttaatgtttttttttttaagattaggaattagaaaaggatttgatttttataatgttgatattatattggaggttttaattaggtaagaaaaagaaataatgagggttgggtgtggtggtttaggtttgtaattttagtattttgggaagttgagatgggtggattatgaggttaggagattgagttattttggttaatatggtgaaattttgtttttattaaatatataaaaaattagttgggtgtggtggtgggtgtttgtagttttagttatttgggaggttgaggtaggagaatggtgtgaatttagggggtggagtttgtagtgagttgagattgagttattgtattttagtttgggtgatagagtaagattgtgttttaaaaaaaaaaaaagaaaaagaaataatgattagtggtttgatgttttatgttagtaattttagtattttgggaggttgaggtgggtagattatttgaggtttggagttggagattagtttgataaagatggtgaaattttgtttttattaaaatattaaaaaaatagttaggtgttggttgggtatagtggtttatgtttgtaattttagtattttgggaggttgaggtgggtggattatttgaggttaggagtttaatattagtttggttaatatggtgaaattttatttttattaaaaatataaaattagttgggtgtagtggtgggtgtttgtaattttagttatttgggaggtttaggtaggagaattgtttgaatttgggaggtggaggttgtagtgagttgagattgtattattgtattttagtttgggtgataaaagtaaaaattttgttttaaaaaaaaaagaattagttaggggtagtggtgaatgtttgtagttttagttatttaggaggtagaggtaggagaattatttgaattttggaggtagaggttgtagtgagttgagattgttttattgtattttagtttaggtgagaagagtaaaattttatgttaaaaaaaaaaaaaaaaaaggaaagaaaaaaaataatgattagaaaggaagaaattaaatatatttatagttagtatgattttatatatattatggttttaatggggttaggtgtggtggtttatgttgtaattttagtatttttaggaggttgaggtaggtggtttttttgggattagttggttaatatggtgaaattttaattttaataaaaatataaaaaattagttaggtgtggtgagggtatttttaattttagttatttaggaggttgaggtaggagaattgtttggatttgggaggtagaggttgtagtgagttgagattgtgttattgtattttagtttgggtaataagagtgaaattttggtagggtgtggttttatgtttgtaattttagtattttgggaggttgagttaggttgattatttgaggttaggagtttgagattaatttaatatggtgaaattttgtttttattaaaaatataagaattagttgggtgtagtggtgggtgtttgtaattttagttatttgggaggttgagatagaagaattgtttgaatttaggaggtggaggttgtagtgagttgagattatgttattgtatattatgttgggtaatagagtgagattttgttttaaaaaaaaaaaaaagatgaaattttattttaaaaaaaaaaaaaagttttaatggaaaatttataaaaagttattaaaattaataaataaatatagtagggttgtaggttatagggtaatatagttatttttttatttgtaggggtttggttttgggattttttatatattaaatttatagatgtttaagttttatatataagatggaatagtatttaatttatatatatttttttatatagtttaaattatttagattatttatattatttttatataatgaaaatgttaatgtatatgtaagtatgtatgtaagtatttgtattatattgtttagggaattattggatagataggtttttaagattgatattagtagttattgttaagattttggttaggtttgtttttgtttggggttttagttgattttattgtttttttatttagttaagggtatttgtattttttttggttttttggttatttggaaggtttagtttagtttggtatatttgtattttggtttattgatgttggtatttttgggaaggttttgttttgaaaaatatggagattttagttgttattgaagatttgagagataaagatagggagatttgtttgtagatttgtgtttttttaagtgggattgagattttgggttttttattttaggatagtattttttggtttgttgattgaatagatttttgaaggaggtgtagttgtattttaggagtgggggtgggagtagtattattgatttgtattaataattatatagttttttttagaataataatatagaataagtgaaatagaataattgtagaaagagttaatttttgttgagtttttattgtgtgtttagtattttttttaattttatattttttataatatatagagtattaggtaggtggggtttgggggtttatgtttgtaattttagtattttaggaggttaaggggggtggattatttgaggttgggagtttaagattagtttgattaatatggtgaaattttgtttttattagaagtataaaattagttaggtgtggtggtatatgtttgtagttttagttatttagtaggttgaggtaggagaattatttgaatttgggaggaggttgtagtaagtggagatagtgttattgtattttagtttgggtaataagagttgagattttgttttaaaataaaataaaataaaataaaataaaataaaataaaataaaaaaagaaaagagtttgttattaaaggagttgtttggtaggggatgttttgttagtgtaaataatagaaaagtgggttgggtatagtggtttatgtttgtaattttagtattttgggaggttaaggtgggtggattatttgaagttgggagtttaagattagtttgattaatatggagaaattttgtttttattaaaaatataaaattagttgggtgtagtggttgatgtttgtaattttagttatttgggaggttgaggtaggagaattgtttgaatttgggaggtagaggttgtggtgagttgagattgtattattgtattttagtttggatgagagtaaaattttgttttaaaaaaaaaaaaaaatagaaaagtgtaataaatatttatagtaggtatgttttttagtaaatttgatgataaatttggtataaagaaagagagtatttttgaaaaaaaaaaaaagaaaaagaaagagagtattttgtttgggtaatatagtgaaattttgtttttataaaaaaatttaaaaattggttgggtgtagtggtttatatttgtaattttagtattttgggagttggaggtgggaggattatttgaggttaggagtttgaaattagtttggttaatatggtaaaattttatttttattaaaaatataaaaaattaattaggtgtattggtgggtgtttgtaattttagttatttaggaagttgaggtaagaggattgtttgatattgggaggtggaggttatagtgagttgagattatattattgtattttagtttgggtgatagggtgagattttgtttttaaaaaaaaaaagaaaaagaaaaagattaaaaaattagttaggtaggtttttgtggttttagttatttgggaggttgaggtaggagaattattgagtttaggagtggtaggttgtagtgagttatgattgtattattgtattttagtttgggttttaaagtaagattttgttttaaaagaaaaaagaaagaaagaaagaatatggtgggttaggtatagtggtttatatttgtaattttagtgttttgagaggttgaggtaggtggattataaggttaggagttttatattagtttggttaatatggtgaaattttgtttttattaaaaatataaaaaattagtaggtagggtggtaggggtttgtaattttagttatttgggaggttgaggtaggagaattgtttgaaattagaaggtagaggttgtagtgagtttagattgtattattgtattttagtttgggtgaaaagagttaaattttattttaaaaaataaataaaaaaataaaataaaaaaaaatatggtagtttttgaaagtttgtttgggagaaggtgtgatgatggttgtataattttgtgtaagatgttggtttatataggggttgttttttgtttttttttgtttttttaattttttatataataggtttgtgtgttatgtatatttattgagtttaagtaggtgtaaggtattgtgatttaatattttggttagtaagataataagatagattattgttttgtttttaggaagtgtatatgttattagaggaaatagataaaataaataaggaaaagtattagataatgtaagtgttatgagaatgtaaatgaggtgatgtgaattaaaataggatgatttaagtttgtatggaaggtttttatttttatgtttttggttagttaaggaattattagttgattagtagagaagggtagtttgtttagttagagtttttggggaagagggagtggttgttaagagatgagattaaagaagttgagatgggttttttgtgagggggggttgtaatgtagggttgaggagtgtttgaagagaatgggtaggtgagtggtgagatagttgtttttttagaagttttgtagtgaaaggaattaaagaaatggagttgtgtattaggtggggaagggtgggggttaagggggtgtttttttttatatagagattgtaggttgagaatgattatatttttgttaataggaggtgggagtagggtatggtagtttatatttgtaattttggtattttaggaggtggaggtgggttgattatttgaagtaaggagtttgagattagtttggttaatatgtaaagttttgtttttattaaaaatataaaaattagttgggtgtggtggtatttgtttgtaattttagttatttgggagattgaggtaggagaatggtttgaatttggaaggtagaggttgtagtgagttgagattatgttattgtgttttagtttaggtgatagagagagattttattttaaaaaaaaaaaaaaatataggaagggagttgggaatagggtgtatatttaggaagttttggggatttagtggtgggaaggttggaagtttttttttgattgttttttttttaaagaagtgtatggttggtgtggggtggggtaggagtgtttgggttgtggtgaaatattggaagagagaatgtgaagtagttattttttttttgttttataggaagttgagttgttttagatattggtatggtgttgggggagggggttttttttttgtaggtttaggtgatttagggttggaagtgttttatgttggatttttatttttttttttgtagt

SEQ ID NO: 656 - DNA, 12963 bp, Artificial Sequence
  chemically treated genomic DNA (Homo sapiens)
gttgtaagaggaaaagtggggatttagtatgagatatttttaattttgggttatttgggtttgtagagaaggaatttttttttttaatattatgttagtgtttgagatagtttggttttttgtggagtaggaaaagaatggttgttttatatttttttttttaatgttttattataatttaagtatttttgttttattttatattagttatgtatttttttgaggaaaagataattagagagggatttttaatttttttattattaaatttttaagattttttaaatgtgtattttatttttaattttttttttgtatttttttttttttttgagatggagtttttttttgttatttaggttggagtatagtggtatgattttagtttattgtaatttttattttttgggtttaagttatttttttgttttagttttttgagtagttgggattataggtgagtattattatatttagttaatttttgtatttttagtagagatagggttttgtatgttggttaggttggttttgaattttttattttaggtgattggtttgtttttgttttttaaagtgttaagattataggtgtgagttattgtgttttgtttttattttttgttaataaggatatagttatttttagtttgtaatttttgtatggggaaggatatttttttggtttttatttttttttatttgatatatggttttatttttttgattttttttattgtaaagtttttggaagaataattgttttattgtttatttgtttattttttttggatattttttagttttgtattataatttttttttatgaagggtttgttttggtttttttaattttattttttaataattatttttttttttttaaaagttttagttagatgggttgtttttttttgttaattaattggtggttttttggttagttaggaatatgggggtaggggttttttgtgtagatttaagttattttattttaatttatattattttatttgtatttttatagtatttatattgtttgatatttttttttgtttattttatttgttttttttaatagtatatatattttttaagggtagggtagtgatttattttgttgttttgttgattaaagtattagattataatgttttgtatttgtttgggtttaataaatgtgtataatatataagtttgttatatgagaggttaagagagtgagaaagagtaaggggtagtttttgtgtggattagtattttgtatgaagttatgtaattattattgtatttttttttagataagtttttaaaggttgttatgtttttttttgttttgtttttttgtttgttttttgagatggagtttggttttttttgtttaggttggagtgtagtggtgtagtttaggtttattgtaatttttgttttttggttttaagtaatttttttgttttagttttttgagtagttgggattataggtttttattattttgtttgttgattttttgtatttttagtagagatagggttttattatgttggttaggttggtgtggaatttttgattttgtgatttatttgttttggttttttaaagtgttgggattataggtgtgagttattgtgtttggtttgttatgttttttttttttttttttttttttttgaggtagggttttgttttgaagtttaagttagggtatagtggtgtaattatggtttattatagtttgttatttttgggtttagtgatttttttgttttagttttttaagtagttgggattatagaggtttgtttggttaattttttagtttttttttttttttttttttttttggagatggagttttgttttgttatttaggttagagtgtagtggtgtgattttgatttattgtaatttttattttttagtattaagtgatttttttgttttaattttttgagtagttgggattataggtgtttattaatgtgtttgattaattttttgtatttttagtagagatggggttttgttatgttggttaggttggttttgaatttttgattttaggtgatttttttgtttttgatttttaaagtgttgggattataggtgtgagttattgtatttggttaatttttgagtttttttgtagaggtagggttttattatgttgtttaggtaggatgtttttttttttttttttttttttttttttagggatgttttttttttttatgttaaatttgttattagatttgttaagaaatatgtttattgtaagtgtttgttatatttttttgtttttttttttttttgagatagagttttgtttttgtttaggttggagtgtaatggtgtgattttggtttattgtaatttttgttttttaggtttaagtgatttttttgttttagttttttgagtagttgggattataggtattggttattgtgtttggttaattttgtatttttagtagagatggggtttttttatattggttaggttggttttgaatttttaattttaggtgatttgtttgttttggttttttaaagtgttgggattataggtatgaattattgtgtttagtttatttttttgttgtttgtattgataaaatattttttattaaatagtttttttaatggtaggtttttttttttttttattttattttattttattttattttattttattttattttgagatggagttttagtttttattgtttaggttggagtatagtggtattatttttgtttattgtaatttttttttggatttaaatgatttttttgttttagtttgttgagtagttaggattataagtatgtgttattatatttggttaattttgtatttttagtagagatggggttttattatgttagttaggttggttttgaatttttgattttaggtgatttattttttttggttttttaaagtgttgggattataggtgtgagtttttaagttttgtttatttagtattttatgtattatgggaaatgtagagttgaggaaagtgttgggtatatagtaagagtttaataaaggttagttttttttgtaattgttttattttatttgttttatattattattttagagagaattgtgtgattgttagtgtggattagtggtattgtttttatttttatttttaaaatgtaattatattttttttagggatttatttagttaataggttaggaggtgttgttttgaaatggggggtttaaagttttaattttatttggagggatataggtttatagataggtttttttgtttttattttttaaatttttagtagtaattaaaatttttgtgttttttagagtaggatttttttaggggtattagtattagtgggttaggatataaatgtgttaggttgaattaggttttttaaatggttagggagttaagagaaatgtaggtgtttttggttgggtgggaaggtaatgagattaattgagattttaaataggggtaggtttgattagaattttaatagtggttgttggtattagttttgaaggtttatttgtttagtgattttttaaataatatagtataagtatttatatatatatttgtatgtatattagtatttttattgtatgggggtaatgtaagtaatttagataatttaaattatatgggaggatatgtgtaggttaaatattattttgttttatatatgggatttagatatttgtgggtttggtgtgtgaggagttttagaattaagtttttatagatagagggataattatattgttttgtaatttgtaattttgttatatttatttattagttttggtagttttttatggattttttattaggatttttttttttttttgagatagagttttattttttttttttttttgagatggaattttgttttgttgtttggtgtggtgtgtaatggtatgattttagtttattgtaatttttattttttgggtttaagtaatttttttgttttagttttttaagtagttgggattataggtgtttattattatatttagttaatttttgtatttttagtagagatggggttttattatgttaggttggttttaaatttttgattttaggtgattggtttggtttagttttttgaagtgttgggattataggtgtaagattatattttgttggagttttatttttgttgtttaggttggagtgtaatagtgtgattttggtttattgtaatttttgttttttaggtttaagtaatttttttgttttagttttttgagtagttgggattagaggtgtttttattatgtttggttgattttttgtatttttattagagttggggttttattatgttggttagttggttttagggaagttatttgttttagttttttaaaagtgttaggattatagtatgagttattatgtttggttttattaggattatggtatgtatagaattatattggttgtgaatgtgtttgatttttttttttttaattgttattttttttttttttttttttttttttttttttgatatggaattttgttttttttgtttaggttggagtgtaatgggataattttggtttattgtaatttttgtttttggggtttaagtgatttttttgtttttgttttttgagtagttgggattataggtgtttattattatttttggttaatttttttttttttgagatggagtttttgtttttgttatttaggttggagtgtaatggtgtaattttggtttattataatttttgttttttaggtttaagtgatttttttgtttaagttttttaagtagttgggattataggtgtttgttattatgtttggttaattttgtatttttagtagagatggggttttattatgttggttaggttggtgttgaatttttgattttaggtgatttatttattttggttttttaaagtgttggggttataggtatgagttattgtatttggttaatgtttggttatttttttaatattttaatagagatgaggttttattatttttgttaggttggtttttaattttagattttaggtgatttgtttattttggttttttaaagtgttgggattattggtgtgagatattgggttattaattattatttttttttttttttttttttttgagatatagttttgttttgttgtttaggttggagtgtagtggtttgattttagtttattgtaagttttgttttttgagtttatgttatttttttgttttagttttttgagtagttgggattataggtgtttgttattatgtttggttaattttttgtatatttagtagagatagggttttattgtgttagttaggatggtttgattttttgattttgtgatttatttgttttggttttttaaagtgttgggattataggtttgagttattgtatttggtttttattattttttttttttgtttggttaaaatttttagtatggtattaatgttgtgagagttaaatttttttttagtttttgattttagaggaaaaagtgttgagttttttttttttttttttttttttttttttttgagatgaagttttattttgttatttaggttggagtgtagtggtatgatttaggttttgtaagttttgttttttgggtttatgttatttttttgttttagttttttgagtagttggtattataggtgtttgttattatgtttggttaattttttgtttttgtatttttagtagagatggggttttagtatgttagttaggatagttttgattttttgattttgtgatttgtttgtttaggttttttaaagtgttggtattataggtgtgagttattgtttttagtagtattgagttttttattattatgtatgttgttagtggaattttgattgtggatgttttgttattaaattagttaagttttttttttttagtttgttaggaggttggttggtttgtaattatgtatatgtgttgatattattaattgtttttgttatatttgttgaaatgattatagggtttttatgtttttttttgttaatgtggtgaattatatagattgatttttttttttttagtaaagattagtttgattatgttgtttaggttggttttgaaattttgggtttaagagatttttttgttttagttttttaaaatgttgggattataggtttgagttattgtattaggttaatttttgaatgttgaattagttataattatgagataaatattatttggttagaatgtatttattttttttttttttttttttttgagatggagttttattttgttgtttaggttggagtgtaatggtgtgattttagtttagtgtaatttttgttttttgggtttaagtgatttttttgttttagatttttgagtagttgggattttaggtgtttattattatgtttagttaattttttttttttttgagatgaagttttgttttgttgtttaggttggagtgtagtggtatgattttggtttattgtaatttttgttttttgggtttaagtaattttgttttagttttttgagtagttgggattataggtaggtgttattatattggttgatttttgtatttttagtagagatggtgttttattatattggttaggttggttttgaatttttgattttgtgatttgtttattttggttttttaaagtgttgggattataggtgtgagttattgtgtttagtttgatttttgtatttttattagaaatggggttttattatgttggttaggttggttttaaatttttgattttaagtgatttgtttgttttagttttttaaagtgttgggattataggtgtgagttattgtgattggtttatttatttttttttttatattattaggtttggtttgttaaaattggttagttgttgtatgtttatgttaataggaatattggtttatattttttttttttataatgtttttgtttggttttggtattaggattattttggttttgaaaataagttgggaaatatttttttattttttttttttttttttttttttttgagatagggttttattttgttgtttaggttggagtgtagtggtgtaattttggtttattgtaatttttgttttttaggtttaagggatttttgtgttttagttttttgagtaattggtattataggtatggtgtatgtttagttatttttgtattttagtagagatggggttttgttgtgttggttaggttggttttgaatttttgattttaaatgattttttgttttagtgtattaaagtgttgagattataggtatgagttattgtgtttagtttgtttttttgttttttgaagagtttgtgtaagatgggtattgtttttttttttaatgtttaaagagagtagagaatagaggagataaatagaaaatagtattaagaggttaggtatggtggtttatatttgtaattttagtattttgggaggttgagatgggatgaaagtttgaggttagtagtttgagattagtttgggtaatatagtgagattttgttaatataaaaaaataaaatagttagttgggtgtggtggagtaattttagttatttgtgaggttgttagaggattgtttgagtttaggggtttgaggttgtagtaagttttgattgtgttattgtattttagtttgggtaatagtgtgagtttttgttttaaaaattaataaagaaaaaaagaaaatagtattaaaatggtagttttatattttaattgtaaaataattaaaattaaaagtatttagtagagaaaggaagtttattttaataagtggagatagaataattggatttttatataggaaagatattagagattgatttttatattttatattataaataattaattttaagaattaattaatggtttaaggattttattgtaaaatttattattataaaggttttaaaagaaaatgtaagattatatttttatgattttggggttaaaaaaaaaaaaaaagatgttttaaataggataaggtaaatattgaatataaaaaagattaatttattttttttaagattttgtaaattttgtaaagtaaataaataggtttgtaatagattagaagaaaatatttatgatttatggatttgataaggatttgtatttagaaagtataaagtagttttataattgaataataaaaataaataaaaaaattaaaataataggtaaaagatttgaagagttattttataaataaaatatgaatggttaataggtatatgaaaaaatgttgaatatttttagttaatagagaattgtaaattataattataaggatatattatattagaaagattgatatatttaatgtttggaaggttgtggtataattataataatttttatattttgttagttggagtgtaaaatggtataattgttttggaaaatttagagtttttgaaaaagtttaaaatatagttattttttattttttttataattttttttttaagtatttttttaagaaatatgaaaatatatgattataaaaagaattgtataagaatgtttatagtagttttattttataattgtaaatgggaaataatttaaaaggttattaaaaggatggatatataattgatggattatattaaatgaaaaggagtaaaatattgatatatataatatgaatgaatgttagatagtatattgaaggatagaagtttgataaaaatgagtatataatgtatgattttttttttttttttgagatggagttttgtttttgttgtttaggttggagtgtagtggtatgattttggtttattgtaatttttgttttttgggtttaagtgatttttttgttttatttttttgaatagttgggattataggtatttattatgtttagttaatttttgtattttttagtagagatggggatttattatgttggttatgttggtttggaatttttatttttaagtaatttgtttgttttggttttttaaagtgtaggtgtgagttaaagtgtaggtgtgagttatagtgtttattttgattttattttatatgaagttttttaataggtaaaatggttatggagattaaaataaaggtggggttgggaattgattgggaagagatgtgatgaaatgtttttgggatgatgaaaagggtttgtgatttggtaggtattatggagtggttaggggttaaaatttatttttttgtgtatttgttgtgtgtattggtgttgtgtgtaaatgttattttgatttaggaaaaagatgatgtaagtatggtataaagtggttggtatgtggtaggtgtatgggaagaaattgtggaatgaaataattgtgagttaagagatggggtagtgggagaaatgaatttgagttttgttttttattaggaagaattggtttgggttgagggttgtatggaggattatatggatgtttgtgggtttgttttttttgttttatgatgtttagtttgtgtttggaattggaatggtttagtttaaagttagataataggtagattgttttttttgataaattattaaatgatttattattgtatttttttaaaattttatttttagatgtattatttttttttttttttttttgggaagatgagatatgtttatttttgaaagtgtttttgggtttgttttttgtatatttttttttttttttgtttatgttatggtagtgtttgtttaggttgtaggtgatttggggggtggggtatattatttaaagaaggggagggattgaggtttgtattaaaataaatatttttgtttttgtaaaggttataattaagtaatttagaaaaagaaatgtaggtggagaatagtagtttttttttgttaagtaagaggaattggtttaaaggatatttttttttttttttttttttttttattgggtgaatagtgagttgttttggtaaaaagaaattggaaatgttgttgtaagaggtagaaatgtaaatgtggagttaaataataatagggttgttgggttttttagattgtgatggttttttttggtttggtgggtaaatttttggtttagtattttttatttttatgattgatagtttttaattggattttttttatttagtggagttgggggttgtttggaaagattgttttaggaaggataaaggtttggaagttgtgggattttagtagtttgggttttttggattatttttaaatgattattttggaatggagttttagtttttattaggatgttatgggttttaaaatatatagttatgagtttttaatgttttgagatttaaaagttttagattttaatgttttgtgtattttttattttagggattttttatgtttagtattgggtggatgtgtaaagaagtatgttttaggttggtttaaggttttttaaagttttatttttttgtttaggtgtttaattttgagtttggatggttttaatatttttattatttatatttaggttttttaataatgtaatttttatgatgatttttttagttaagtttttattttatttatttttaaatttgttaagtttttattgttttatttttagttttagtgatttttttgagttgaaaatatatggagttgagagtttgtgatttagagaggatttattaagtttagttaggagtttatttaatttagggaagtgtgttattgttgtggaaagtatgtttttagtttgaatgtaaagtgtttttggagtttagtagttatttgttttttggatggtggttttagatttttgagaagtttaaaatttttagtgttagttttgagtatatgggaggggaaaattttaattttattaatttttgtgaggtttttggtataaagttggatagttgttatgataagtaagggtaagtaatttgtttgttggaggaagtaaaggaaatggagttggggaggagggtgtagagttaggatttttgttgatttggtgttgtagatattaatattttggggtggaaaattttgtaagttagagttgtgagggtagaattggtggaaattattttggaggaattttgtattgtgttaaatatgaagggtggaaggaagaaagtttttgtgtttgtttttagttggattttttttttttattagttaaaatgttattttttaggaaggttttttgtaatattatattttaatgtttttttttagatattttatattatattattttatttaattttttttataatttttattattttgataagatttatttgtttattgtttttagtatatggaaatgtaagttttatgaggatatagaatttttttattattttatttattgttgtatttttgagtgtttatattagtgttgggtagtaagtaagagtttgataataaatattttttgaatgagggagataggtttgaagtttggagaatgagatgtagaagaggtgtaagatttgttgtgttttttgtaggtggtgggggggtggtgtaggtgttttaagaattattgtgggatttggtagggggagtgtaggtgttttttgttaagatagaagtgtttagattataatttttagtagttatgaggagttttagggtttgatgggaatgggaaattttttaattttttatgttttggttttgtgggttttgtgggttgtttgtgaaatttgatttgggatgtggtggtttaattggaaggtggattgaaattttgtgatagtaagaggtttgtagtgatttgtggtgttaaggaatatagtgtttttaaaagaattggtgtttgttgtttgtttttttttttgggagttttttgtttatttttagaagaggagggaagtataggtgggtttttttagttttgtgttggatttttgagaattttgaagttattttggttgaggttaatttttgttgtgttttttttgtagtatgaagattttggagatttaattgttagttttggattgttgttttttagattaggatttagttttagtttatttttttttttatgtttttttgatgaataaaaatgtggattttgaattgatgttattgttttttgaaaggggggatttgttttggttgtttttagattttgtggttggtttagttgtgttttaggagttatgggagggggatttagtttttttttttatttttttggaaatagagtttggtttttttagtgagttgagtttttgaattgaggagtaagaattttttgaaaatataagtttttttgtagaagaagtaaatgggagtttttttgaagaagaagtgaatgggttagagttggggtttggaaaagttatggaagatatttttggggaatttgttgtagaggatgagggagatatgtaagtggtgatggtagtggagtgtggagtttggggagatgaagtgtgaggttgatttgttttttggttttgagatttatttttttaggtttttgttttttttgtttggtgatttaggtttattgttttttattttttttttagtgtttggaattatagttttttttagttgttttgattttttagtggtttttggttagagtttagtatttaatttgagaattttttgaaaggttgtaagtggtaaggataataatggggtagggagttgattatttttgagatttttattgtaaaatagtttagttttttaggagagggatgttttagagttgggagaagtggtatgtagtttttttagattgagtttatattttatttagtagtttgtgttttttattttttttaaggatttaggggggtttatttattttagaggtaggtttagttttagttttatatttgaaaagtataggtttggttagttttttaatttttttttgtttttagggtttttgat

SEQ ID NO: 657 - DNA, 3077 bp, Artificial Sequence
  chemically treated genomic DNA (Homo sapiens)
ttatattgtgtatgtaatgtataagtatttattttgtttgtttggggttttgtttgtttttgttgagtttgatttttttatttgttgtttggtttttgttttatgttttagtgttattgagattaaggagagaatgaatttgttgttgattgggtagagtgagtgtgtggattgtggttattgtttgtttattatttgtgtgtatttgggttggtattgggtgaagaattgtgtgggtttgggatttgggggtttagagggagtgagtttttgtgtgggtgtttggtttgtaggttttgtaggtttaggggtgtgttttgtttttatttttattttggattttggtttttttttttagatagtggttttttttatttttggtttttgtaggttgttagtagtttgtgttaggttttgttggtgtttttagggttttttagattgtgtagattttgatatttttgtttggttttgggttttgggagttgagagttggttagggttttgtttgtatttttgggtgtttagttttgggtttgttttttgtggatgttttaatttttttggttgaatggatggtggtgtgtgtgtgttttattttggtggtgttggttttttttgttgttaaaattagatttaaatttttgtatgggatttgtttttgggtttttattttgtgtgtttagtaaatagtgggtgagttatgaagatgtgtgagttagttggattttttttgttaggtgtggatttgttgtggttagagaatttagtttgtgttagtttggtttgtttgtgaagttatgggttttattgatgtgattttttaagatgtgggggttattatgggtagaggatattggtttggagttagattatgggttttataagtattagattataagtagtgttgttattgagagttgtttggaatttgtttagtatgttgggttttttagttagggtttggtgtatgtggttgagggttttggaagttttgatggtttaggaggagtaggtgggtggggtggtgggtgttgttggttggtagagagttttggtttgatttagtgtaggtttggtgtgtgtagagaataattttaagtgtattgatgtttgtgagttttttttaaatattgaatgggatttagagtttgagtttataggtggtggttgggggagggagtagggtgttggttgttgtttgggagtgtttgtgttttgggtgatttttggaaggatgtggggtttaaattttggttggggttgggagagtagtttttagaggttttttgtgggattttttgttgggtgggattgtggttttataggagaagtgggtggtaagttttgtttggtggaaagtagttgtttttttttttttgggtttggggtggtgttttttatttttgttttttgttttttatttttgttttttgttggttatattttttgttttttggattttaagtgttttgtgtgttgaggagtttagtgttagtggtggtggttaggagagatttgggtgttaggaaagatgggttgtttgggggatagtagggagtttgggggaaatgtaggtgttgggtatagagttggtattggtgtttttagttttgttgaagattgtggttgggtttggtttgtgggaggggttttggtgttggatttgttttggttttgtgtgggtggttttgttgggttttgtaggagtgatgtgtgttaaaaggtggtgggaaggaggtggggtagagtgtgtttgggattttgatttggatgtggttagttggagaggtggagtgttgggaggagattttggttttgttgtgatttggtggtttgtgttgtttttttgtgtgttgggttaaaaaggtgttaatgtttgtggttgtttattttttgtggtgttttttttttttgtgtttatataatttgtttaggggttgggtagtttgttttgtttttttgtttgtgtatttgtttggaggtttgtgtgtttgtgaaggggatgtagtgaaattggggtttgtgttaggttagttgggatggatgttgatgtttggggttgtgatggttgtaggtaggaggtttagggttggggggtggtttggttttgtgggtgggggttggagtgtagtgttgggtaggtatttgggtttgtagttttgaagttgggaggtgaggggagagtgattggggatgagttgggataaggtgatataggggtttttttggagttggattggtttttgggatttggtgtttgtgagaggttggagtggttagagtttagtttgtgaggagatgtgggttttgtttttagtgttggttgtttttggtgttaaagatagttttgtaggggttttgggagggttttttttttgttgttttttttttattttgggttttgagggttgttgggagggtaattttgggaagaggttggggtgtggggtgtgggtgtaggtggaaattgttagtaagtttttttttgtttgtgtgttttttttgatttgtagggttgtgttaattttgaggttttagtttttttgaggagttagggttaggtttttttttggatagggagaaggatttgggtgggggttttgatttatggagttggttattaagtggttttgatggttttttgagggatagttttttgtggttttgagtttgtttgttgagggtttttggtttgtttttggagtggttttaggtagagaaagtttgtgaagaaatggtttgggttggtttggagggagatattttatgtttttttagtttttgggttgtttttttttgtagtttttgttttttttggggtttggatttggggagtgatgattatttttgtttagtttgtattttggtttggatgttaggagataagtttatgtagtatgtatatgtttgttatataaataggggatagatagatgatttttaattagtaagggtgtagggaaaagtaatgtattttaaatttttgattagaggttatttgtttttaaagatgttgttatttgtttatttattgtttggatatttggaaatggtttaggtttattaatataatg

SEQ ID NO: 658 - DNA, 3077 bp, Artificial Sequence
  chemically treated genomic DNA (Homo sapiens)
tattgtgttaatgagtttgagttatttttaaatgtttagatagtgaataaatagatggtagtatttttggaagtaaatgatttttggttagaagtttggggtgtattgtttttttttgtatttttgttggttgaagattgtttatttgttttttgtttatgtagtagatgtgtgtatattatatgggtttattttttagtgtttaggttaaaatataagttgagtaaaggtaattattgttttttaagtttaagttttgggaaaggtaggggttgtaggaggaggtggtttaggagttaagggggtgtgaggtgtttttttttaggttggtttgggttatttttttatgggttttttttatttgggattgttttggagataggttaggagtttttgatagataaatttagagttatagggagttgttttttgggaaattattgaaattgtttagtaattaattttatgggttaaggtttttgtttagatttttttttttgtttagaggggggtttggttttggttttttagggaagttgaggttttgggattggtatagttttgtaggttggagggagtgtgtgggtggggaggagtttgttggtgatttttatttgtatttgtgttttgtattttggtttttttttggggttatttttttaatggtttttggagtttggggtggagaggggatagtaggaggagggtttttttggaatttttgtggggttgtttttggtgttaaaggtggttggtgttgagggtaggatttgtgtttttttgtaggttagattttggttgttttagttttttgtgagtgttaagttttaggggttgatttaattttgagggagtttttgtgttgttttgttttagtttgtttttgattgttttttttttattttttagttttggagttgtgagtttaggtgtttgtttagtgttgtgttttagtttttgtttgtggagttgaattgttttttggttttgggttttttatttgtagttgttgtagttttgggtattggtgtttgttttggttggtttggtgtgggttttggttttgttgtgttttttttgtgggtgtgtgagtttttgggtgggtgtgtgggtggggaggtagggtgggttgtttggtttttaggtgggttatatgggtgtggggaggggaggtgttgtggggagtaggtggttgtgggtgttagtgtttttttagtttggtgtgtgggaaggtagtgtgggttattgagttgtggtggggttaaggtttttttttggtgttttgtttttttagttggttgtgtttaagttggggttttgggtgtgttttgttttgttttttttttgttgttttttggtgtgtgttgtttttgtagagtttggtgaggttgtttatgtagggttgaagtaggtttggtgttagggttttttttgtgggttagatttgattgtgatttttggtagagttggggatgttggtgttgattttgtgtttgatgtttgtgttttttttggattttttgttgttttttagatggtttattttttttgatatttgggttttttttggttgttgttattagtgttgggttttttggtgtgtggggtgtttggaatttaaggggtaggggatgtggttggtggggaataggggtgaggggtggggaataggggtgaggggtgttgttttaggtttaggaggaggggaatggttgttttttgttaagtagggtttgttatttattttttttgtggagttatggttttgtttggtagaggattttgtggagagtttttgggggttgtttttttaattttagttggagtttgggttttatgtttttttaggggttatttaggatgtgaatatttttgggtggtggttagtattttgtttttttttttggttgttgtttgtgggtttgggttttggattttgtttggtgtttggaaggagtttgtgggtgttggtgtgtttggagttgttttttgtgtgtattagatttgtgttaggttaggttgaagttttttattggttagtgatatttgttgttttgtttgtttgttttttttaggttattggggtttttagggtttttgattatgtatattaggttttggttaggggatttgatatgttgggtgagttttgagtggtttttagtggtggtgttgtttatggtttgatgtttatggggtttgtgatttggttttgaattgatgttttttgtttatggtgatttttatgttttggaaagttgtgttagtgaagtttgtggttttgtgagtgagttgggttggtgtagattgggttttttggttgtagtgggtttgtgtttgatggggagggtttggttgatttgtatatttttatggtttatttattgtttgttgggtgtatggggtggggatttaaagatgaattttatgtagaggtttgggtttagttttggtaatagaaaaggttggtattgttggagtaggatgtgtgtgtattattatttatttggttggggaggttggggtgtttgtggggagtagatttgaggttgggtgtttggaggtatgagtaggattttggttggtttttagtttttagaatttagggttaggtggggatgttagggtttgtgtgatttggggggttttagaggtgttggtggggtttggtgtggattattagtggtttgtgggagttaggggtggagggggttgttgtttagggaagaggattggggtttggagtgggggtgagaatgaggtatgtttttgagtttgtgaaatttgtggattgagtgtttgtgtaggagtttgttttttttgggtttttaggttttagatttgtatgattttttgtttggtgttagtttagatgtgtgtgggtgatgaatgggtggtggttgtgatttatgtgtttgttttgtttagttagtggtaaatttgttttttttttgattttagtggtattggagtgtgaggtaagggttaggtggtaggtagaggggttggatttagtaaaagtaaataaaattttaagtaaatgaaataaatatttatatattatatatatgatataa

SEQ ID NO: 659 - DNA, 3814 bp, Artificial Sequence; identical to SEQ ID NO: 631
  chemically treated genomic DNA (Homo sapiens)

SEQ ID NO: 660 - DNA, 3814 bp, Artificial Sequence; identical to SEQ ID NO: 632
  chemically treated genomic DNA (Homo sapiens)

SEQ ID NO: 661 - DNA, 3223 bp, Artificial Sequence
  chemically treated genomic DNA (Homo sapiens)
aaaattttaaatttagttgggtgtggtggtttatgtttgtaattttagtatttgggaggttgaggtagttggattatgaagttaggagtttgagattagtttgattaatatggtgaaattttgtttttattaaaatataaaaattagttgggtgtggtggtgtatatttgtaattttagttatttgggaggttgaggtaggagaattatttgaatttgggaggtggagattgtagtgagttaagatagtgttattgtatttagtttgggtaataaaataagattttgttttaaaatagaaaaataaaaaaaataaaaaataataataataataaaatttattagtttagttttatatgtttatttattgttagttagtttttattttttatagtagaggtatttaatttttgggttaggggtttgtattggtttatagtttgttaggaattaggttgtataataggaggtgagtggtaggtgagtgaaattttatttgtagttatagttattttttattatttgtattattattagagttttattttttgttagattagtggtggtattagatttttataggagtttgaattttattttaaattgtttatgtgagggatttaggttgtaagttttttatgagaatttaatgtttgatgatttgttatggttttttattatttttagatgggattatttagttgtaggaaaataagtttagggtttttattgattttatatgatggtgaattgtggaattattttattatatatattataatgtaataataatagaaataaagtatataataaatgtaatgtgtttgaattattttgaaattattttattttggtttgtgaaaaaattgttttttatgaaattagtttttggtgttaaaaatgttgaggattattgttttatagaatttattggttattttttttttttttatttttttgttttaaaagtatattttgtaaatttgttatgaattgatattttgtttttattttttttttttttgtgtttgtgtttggaggaagaggataaaggataagttgttttaagttttagtgggtagtttgaagaagtgaaatttatatgttggttttttgtttttttattaagtttttattatggtaatttttggttttgtttagttattattattttatttagtatatttttaattttagttagataaggttgttgatataagagagtttttaggggtatagagagagtttggatatgtggggagttagttgtgtattattggaggtggttgggtatatggtagggatgagggaaagattaagagttttttgttgggtttaagttttagatagataaaatttagataattatgtggttggttgtatgttttgtggttgttgggttgggtttaggaggagggaggggtgtttttttttggaggtggtttagagtattgggtggatagttttgggggaaaatttttatgttttgatggaggttatttttgataattttatagtgatttggtttgttaaaggaaaagtaggtaatgtgagttgttttttttttttttaagttgaatattaggggttttaggttttttgggttatttggtatggtagatagttaatttggtaggatatttgggagagatagatataggtagagggtagaaaggttaagggaggtttttaggttaaggttattggggtttgtttaattgtttttgaatgtttttatatatgtatatatatagagtagtatatatatatatatatatatgttttagtaagttttagagagggaggtgttgagggggatttgttggttgtttagatggatttttagagttagtgagtgggtggggttggaatatgagtttatttattttttgtttatatttggtataaaaggaggtagtggtttatagaggagtatagttgtgtttggttgtagggttaagagtgttgttaagaagatttatatgtttttttttagtagttgaatttttgtagtttagtagttgttgttagagtaggatgaattgttaattgtaaggtatttttgagaattttaggtaggagaaaagtaaattttttttaattttttattttgggtttaaggtagagaatttgtttttttagaattttttttttttatgattttttgttatttttttatttttttttttttggatttgtagttttgggttgattttgttttaggggtgattgtaggagagtagggaggatggttaggtgttattaataattttattatttagtaataagaattttgatttttttagtttttttgtattaagatatttatttattttttattttatgtttgttaatttgaatgaaataattgttgggaaagtattaagagaattaaggttgggtattgtggtttatgtttgtaattttagtattttgtgaggttgaggtaggtagataatttgagtttaggagtttgagattagtttgggtaatatggtaaaattttgtttttttaaaaaaatataaaaattagttgggtgtgttggtgtgtttgtatttttagttatttgggaggttgaggtgggaggattgttttagttggggaggtggaggttgtagggagttaagattgagttattgtatttagtttgggtgatagagtaagattttgtttttaaaaatgaatgaaaggaaggaagaaagagagagaaagagagagaggaaagaaggaaggaagtaaagaagaaagaaagaaagaaagaggaaagaggaagaaagaaagaaaagaaagaaaagaaaagaaagtaaatttaaagtttatgtaaattaaagatgttgtgataattgataattgagtttgggttaaattttttttgggttgtaaaggtagagagtggtaatgattttttatttgttttttttttaaggtttttttatgggatatagagggaagggagatggattggattttaagatttttatagggtaagatgggtgaagattttttgttattgtttggggataagttagtttgagtgagatggagtgggatgggtttagaatttgaatatgttatggtttttttttgtattttgttttagtgtttatttattatttgtttgtaggaaataagaagagtagggtttatagttggttagtttttttttttttttgtttgttttttagaatgatttttttattagttttttttttattgttttagg

SEQ ID NO: 662 - DNA, 3223 bp, Artificial Sequence
  chemically treated genomic DNA (Homo sapiens)
tttagagtaatggaaagagggttggtgaaggaattgttttggaagataggtgggaggggaggggagttggttagttgtgggttttgttttttttgttttttgtaagtaggtggtaagtgaatattagggtaaggtgtaggaagagattatgatatgtttaggttttaagtttattttattttgttttatttagattgatttatttttgggtagtggtagggagtttttgtttattttgttttgtgggaattttggaatttagtttattttttttttttttgtgttttgtaaaaaagttttagaagaaaagtaggtgagaagttattattattttttgtttttgtagtttagggggaatttagtttagatttaattattaattattataatatttttgatttgtataagttttaaatttgtttttttttttttttttttttttttttttttttttttttttttttttttttttttttttttttttttatttttttttttttttttttttttttttttttttttttttttttttttttttatttatttttagagatagggttttgttttgttatttaggttgggtgtaatggtttagttttggttttttgtagtttttgtttttttagttgaagtaatttttttattttagttttttaagtagttgggaatataggtatattagtatgtttagttaatttttgtatttttttgggagagtagggttttgttatgttgtttaggttggttttaaatttttgggtttaagttatttgtttgttttagttttataaagtgttgggattataggtatgagttatagtgtttagttttaatttttttaatgtttttttagtgattgttttatttaagttagtaggtatgaggtgggaaatgggtaagtgttttgatgtagagggattgagagagttaaggtttttgttattgggtgatggggttgttggtgatgtttgattattttttttgtttttttgtagttatttttagggtagggttgatttaaggttgtaggtttgaggaaaagaaaatagaggaatagtgggggattatggagggaggagattttggggaggtgagttttttgttttaagtttgaagtaagaggttggagggagtttgttttttttttatttgaagtttttagaggtgttttgtgattggtggtttgttttgttttggtggtggttgttgagttgtaggaatttagttgttggaggggggtgtgtgggtttttttgatagtgtttttggttttgtagttaaatatagttgtgtttttttgtgggttattgtttttttttatattagatgtgggtaggaaatagatgaatttatgttttagttttatttatttattggttttgggagtttgtttgaatagttagtgggttttttttgatatttttttttttgggatttgttgaggtatgtgtgtgtgtgtgtgtgtgttgttttgtgtgtgtatgtgtgtaagagtatttaggaataattgagtaaattttaatagttttggtttgagaattttttttgatttttttgttttttgtttgtgtttgttttttttggatgttttgttaggttgattgtttgttatgttgggtgatttaaaaagtttaggatttttagtgtttagtttggagaaaaaaaaaatagtttatgttgtttgttttttttttggtgaattaggttattgtggagttattaaagataatttttattaaaatgtggaagtttttttttagggttgtttatttggtgttttggattatttttaggaaagagtgtttttttttttttttgggtttagtttaatagttatagggtatgtagttagttatgtgattgtttaggttttgtttgtttaggatttgggtttaatagaggatttttggttttttttttatttttgttatgtgtttggttgtttttgatgatatatggttgattttttatgtgtttagattttttttgtgtttttgagggtttttttgtgttaataattttgtttggttgaggttggaggtgtgttgggtggggtggtggtggttgaatgggattaggggttattatggtaaaagtttggtaaggaaataggagattaatgtgtaagttttatttttttgagttgtttgttaggatttggggtagtttgttttttattttttttttttagatatagatataaggggaaaagggatagaaatagagtgttaatttatggtaggtttgtagggtgtgtttttagggtaagggggtgaggggaggaagagtgattgatagattttgtggagtagtggtttttaatgtttttggtattagggattggttttatggaagataatttttttatagattagggtgggatggttttgggatgatttaagtatattatatttattgtgtgttttatttttattattattatattgtaatatatataatgaaataattttataatttattattgtgtagaattagtgggagttttgagtttgtttttttgtaattagatggttttatttaggggtgatgggagattgtgatagattattaggtattagatttttatagggagtttgtaatttagattttttatatgaatagtttagaatagggtttgagtttttatgagaatttaatgttgttgttgatttgatagggagtggagttttggtggtaatgtgagtgatgaggagtggttgtaattatagatgaaattttatttatttgttatttattttttgttatgtagtttggtttttaataggttatggattagtatgggtttttggtttagaggttgggtatttttgttgtagagggtggaaattggttagtagtgggtgagtatgtagggttagattagtggattttgttgttgttgttgttttttgttttttttgtttttttgttttgagatggagttttattttgttgtttaggttgagtgtagtagtattattttggtttattgtaatttttgttttttaggtttaagtggtttttttgttttagttttttgagtagttgggattataggtgtgtattattatgtttggttaatttttgtattttagtagagatggggttttattatgttggttaggttggttttgaatttttgattttgtgatttggttgttttggttttttaaatgttgggattataggtatgagttattgtgtttagttggatttggggtttt

SEQ ID NO: 663 - DNA, 5034 bp, Artificial Sequence
  chemically treated genomic DNA (Homo sapiens)
ggatttttttgttttagtttattgaaagtagttgagattataggtatgtgttattatatttagttaatttttgtatttttagtagagataaggttttattatgttggttaggatggttttgattttttgattttgtgatttgtttgttttggtttttttaagtgttgggattataggtgtgagttattgtgtttggttaagatgtagttttaataaggagtttggttatttaggtttgtaattgattggattattgtatattttttaaaattaatttgtattagtttttttttttttatttttttatttttaatttttgtattagtatgtatgttttatttttatttaggtttttttttatgagtttaggagtattattattatttttttgtagggattaggattaggtttgtgaagtgaatagtgtttttttaatttgtagagggaaggtagtattttttggtttgttgttgtagtttttttttaaattaaatagtaggtttattttttttgtggtattttagaaggaatattagtaggaatagttttatagatgttgatgttttgtttaaggttattttaagaagttttgtggtatttgtaatgtgtttgtatatttttttttttttaaaaaatatatttttgtagattttgttgaaagtagaaataaatataagtaagtaaagttttttttagtatagtatgttaattatatattttgttatattttgtgaaatagtaagtaaatgataatttttaattgttgtttgggttttgtaaaatagaagattaaattttgtgttttgttttggtaagaaaagaaattgtagtattttgtttagatttttataagttttggggtttatattattggttgaaattgttttttttttattttatagaaaaatggaaaatattagtaaatttaaagatttaaatattattttaaaaggaatataataaaaaatggaaaatattagtatatttaaagatttaaatagttttttaaaaggaatataattaaaattgtagtttaaaatataatttagttttataagagaggtaattggttgtgtgttttatttgtaatgtagaggatttgaagtatttatttttttttttgtttttatggatttatgaataaagattttgattttttttaggattaggaaaattatgaaaaatttaaagtttgggtttaaggtttgtagaagttgtataggtatattaattttagtaagatgggtgttaggaaaaagaataaaatagtaggggagaaatatttaggtattttaaaaaatatttagtggaaatgtaaaaatattaaagattgattaaatattgtagtatgatatagatttagtaattgagtataaataatttgatttggatattgttttaaaatttgaagaggattaattttttttaggaggataattattttgttttttgtagatttttttttttggtagttgaaggagtgtggttaatttgtttttatttttttgtggattttttatttttaggattttttgtagtattttaaattggaagtggttgttgtagatttaaggatgaggggtatgtgggagttggtagttttagtggagtggttggagatgttgaggtgggagggttatttaggtggggtgaggttggggtaggtagtggagtgaatggtttttgaagttttgggttgtttttaggttggattaagtaggtgttttgtttttgtttttgtttagggtgggtgttttttgaggattttttgttatatttgatttgagattgtgtgtttagtttagaatgtttttttgatttagtgtagggttgttgtgattggtgtgtagggggtggtgggaggtttggtgaatttgggggtgggattaggtgggtaaggtttggttgttgtagtgttgttttgtgtgaggtggttttgttgtggtggagggatatggtgtattatatatatattgtggggtgtagatttgtgttttggtagtggtgttgggagtgttgtggatgttgtgttgttatttgtagttaggtggtggtgtaggtggtggtggtggtatagtgtatagtgtgttttagtagtagtagtagtagtagtggtattggaggtatttttgttgttgtagtttttgtgttggtgtagttatttttgttttttttgttttttttttttttgtttgtattatggtaggttgggagtggtaaatgttggtgtagtagttgtttgagatttttttttagatttttagttgttttgtttgttttttgtttgtttttggtttttggaggttttttttttttgagtgttatgtagtagttgtgtttaaaggaggttgtattttggatttgtattttggtgatttttgttagggagttttatttattggttttttttggagttggatttggttgtaggttgtttatgggtaggggttttggttgtaattgtagtgggggtttttgtatttaatttttttgttttttgtttagttttgtatttattgtatttattagtgttgtatttgggttgtttgtagtgtagtgttttggtttgggagttgggtggggttgggtattagatttttttttttggtttgtttttttttattttgtttttttgttggtgtgaaggtggtaggttgggtgggtagtggagaatgaatgggttggagttggttggtggtgtatattgttttggttgggtgttgaggggtgtagttagtgtttgttatttttttattttggttggttttgttgggtgtttttttttggttgtttttttttttttttttttggggggtgtggtgtgggtgtgggttgggaaggaaggagttggggaagggtggggttgggggtaggaaggtgaggggttgggggtggagagggtggaagtggtggttgggttgttttgtgtttgggtggggttttgtggtgtggttgtggtttgtttttgttgtttttgtattttgtggttttttatttagtgtagtagtgtgggtgggtgtgagttttggtgtattaggaggtattttttgtgggaggtgttgggtttgtgttaattggggtggggggggggggtggtgggggaggagggaattggtgtgtggtttggtttttattagagatgtaaagtttttgttttgggaggaggtggtggtgttgtgggtttgttgtttgggggagtagaagtgggtgggaggtgtgggtggttttggttttagttttggtgtgtgggggttgggggtggtgatttttttggttgaggaggggtggtgtttagatgtttgtttgggggttgtttttttttttatgtttgtttttgggtatgtgttttgtttggttttttgttttgtgttatttttagtttgtagagagatgttttttatgtttttgttttttttgtagtttttagattgttagatgtgattgtgtgttttgttgggtgtgttttttatagtttttttttttttggtgtgtagggttgatattattgattgtgtttttggtttggtgggtggggagatggttttttgtagggttttggtatatttttgtttttagggttagtgttatttgggggaggaggtttttgttgttgagaaagttggatgtttttggtaatttttttaataagagagttttgtagtgaggtgggattgttttttttataaggtgatagttttttttgtgaggtgtggtagtgttttttgttgtataagatagatgttgttttggtgttatgtaaattattgtgtttttgttatttaaagaaagttaatttttagtgattgaggtagaaagaaagatttgtttataatttgtaaaaataaatttttatttagaattaatatattggaatattatttttattgttaaagtttttatttaagagtataaattttattagttttttattaggatttattttgtaattggttttttaggtatttttttttaaaagagaaatttatgttagttttttttgaggttttgagtttttttggttggaggtataggtttagtggagattaaataatgtaggtgaattatttttgtggttattattgtttttaatgaagtgtgtttattaagaatagtttttatgttatttttaaggtaggtagggttaatattttttagtaaatttagtagatattttttgttagaaaagagaggagtatatatagtttgataattattgtgtagttttttgtgtatttaatttttgtagttttgtaatattttatttgtaagatggtattatttttttttggtttttgaattataggatagtttgatttagggtattagttattgtaatggtaggtttttaataaataattgtttaatttaaaggattggaaagtatttgttatatggaaatgaagttggtggtgtatttagttgttgtatttttattttttttatttaattattttttataaaatggatataaaagtttgttaatttaatttaatgttattatgtaatgttagtttggagattttgagggtttggagtagtgtgtaaggtgtgttgaaagtttgtttttggatgagatttttattttggttgtgatggtagtggtagtgggttgggttttttgttgagtggaaagggggattgtggtgtttatggtgtagtaggtggtgtttttttgttttagagtttgttgttattgtagttggtgttaaggggttttttgttattagaggtgttattttttatatgatgaatttagtttagttagattgtagagtaagttgtaagttatgggtttagaaaagaaaatttgaagtgagtagatgttgttatttttttgtaattttttgttaaaatagtataaggagttttttttattttatttatttttattaaatgattgtgttataggttttaaaggattttaagattgatttttgaaagattataatattaaaagtataattggaaaatttatgttgaaattaattaaatatgttgtggattgaatgataattttttttttttttatatagg

SEQ ID NO: 664 - DNA, 5034 bp, Artificial Sequence
  chemically treated genomic DNA (Homo sapiens)
tttatatgaagaaagaaaaggttattatttagtttatgatatgtttggttgattttaatataggttttttagttatatttttaatattgtgattttttaaaaattaattttaaaattttttgaaatttgtagtatggttatttaatgaaagtaaatagaataaagaaaattttttatgttattttaataaaggattataaggaagtgataatatttgtttattttaagtttttttttttgggtttatggtttatagtttgttttgtgatttaattaggttaagtttattatgtgaaaaatggtatttttagtggtagaaggttttttggtattagttgtagtggtggtaggttttaagatagaagagtgttatttattgtattatggatattgtagtttttttttttatttaataagggatttagtttattgttattgttattatagttaggataaggattttatttaggggtaggtttttagtgtattttgtgtattgttttaggtttttgaaatttttaaattggtgttatataatggtattgggttggattaataggtttttatatttattttatgagaaataattaagtagaaaaaataaagatatagtaattgggtatgttattaattttatttttatgtaataaatgttttttaattttttaaattaggtagttatttgttaaaagtttattattataatggttaatgttttgggttaaattattttatgatttagaagttaggaaaaaatggtattattttataaatgaagtgttataaaattgtaaaaattaagtatatagaaaattatataataattattaaattatatatattttttttttttttggtaaagagtatttattaaatttgttggagagtattaattttatttattttaagaatgatataagaattgtttttaataaatatattttgttggaggtagtaatggttatgaaggtaatttatttgtattatttggtttttattgaatttgtgtttttagttgagggaatttgagattttaaggagagttaatgtggattttttttttaaagaaggatgtttaagaagttaattataaaataagttttaatagaaagttgatgaagtttatatttttaagtgaaaattttaatagtaggaatggtgttttaatatattgattttgggtgaaaatttgtttttataaattataaatggatttttttttttattttaattattaaaaattggttttttttaaatgatggagatatgatgatttatgtaatgttaaggtaatatttgttttgtataataggaagtgttgttatattttgtaagagaaattgttattttatggggagaatagttttattttgttatagaatttttttgttagaggggttattaggagtatttaatttttttgataatgaaaatttttttttttaaatggtgttagttttgggggtaaaggtgtattagaattttgtggggaattatttttttatttgttaaattagaaatgtagttggtgatgttagttttgtatgttgaggaggaaggggttgtggaaaatatatttagtgaggtgtatagttgtatttggtaatttagaggttgtagagaaagtagaaatgtggagggtatttttttgtggattggaagtggtgtggggtgagggattgggtagggtgtgtgtttgggggtaggtgtgggggggaaggtggtttttgagtgggtgtttggatgttgtttttttttggttaggagggttattatttttggtttttgtgtattagggttgaggttaaggttatttgtattttttatttgtttttgtttttttaggtgatgagtttgtggtgttgttgtttttttttggagtagaaattttgtgtttttaatggaaattaagttgtgtgttagttttttttttttttgttgttttttttttttgttttaattagtgtgagtttagtgttttttgtgggaagtgttttttggtgtattgaggtttatgtttgtttgtattgttgtattgggtggggggttgtagggtgtgaaagtggtaggaataagttatggttatattgtagggttttgtttgggtgtagggtggtttggttgttgtttttgttttttttgtttttaattttttgtttttttgtttttaattttatttttttttggtttttttttttttagtttatgtttgtgttgtgttttttgggaagaaggaggggagagtgattgagggagggtgtttagtagggttggttaaagtggggaggtggtgggtgttgattgtgttttttaatatttggttggaataatgtgtgttattggttagttttagtttatttattttttattgtttgtttgatttgttatttttgtgttggtggagaagtggggtggggaggggtgggttgggggggggggtttagtgtttggttttgtttggtttttaggttgaaatgttgtgttgtaggtagtttgggtgtggtgttagtggatgtagtgggtgtggggttgggtggggggtagggggattggatgtagaaatttttgttgtagttgtggttggagtttttgtttgtggatggtttatgattaagtttagttttaaggggaattaataaatgaagttttttggtagaggttgttgagatgtaaatttaaaatgtaattttttttaagtgtagttgttgtgtaatatttagaaaagaaaaatttttaagaattaaaaataaataaaaaataaataaaataattagaaatttgggaagaaattttgggtagttgttatgttggtatttgttatttttgatttattatggtgtgagtgaagggaggaagagtagagggagtgagggtggttgtattagtgtgggggttgtgatggtgggggtatttttgatgttgttgttgttgttgttgttgttaaggtgtgttgtgtgttatgttgttgttgttgtttgtgttgttgtttgattatgagtaatggtatggtgtttatgatatttttagtattattgttggagtgtgagtttgtgttttgtgatatatatatggtgtgttgtatttttttgttgtggtggagttgttttgtgtagagtggtgttgtggtagttgggttttgtttgtttggttttgtttttgggtttgttaggttttttgttgttttttgtgtgttagttgtggtggttttatgttgggttggggaagtgttttaggttgggtgtgtggttttgggttaggtgtggtggggagtttttaggagatgtttattttgggtgggggtgaagatagagtgtttgtttagtttaatttgggggtggtttagagttttggaagttgtttattttgttatttattttagttttattttatttgggtgatttttttattttaatatttttaattgttttattagggttgttggtttttgtgtgttttttgtttttgggtttgtagtggttatttttagtttggggtgttgtaggaggttttgagagtagggggtttgtggggaggtggaggtagattggttatatttttttagttgttgaggagaggggtttgtagaggatgaggtagttgtttttttggaagaaattggttttttttggattttggagtagtatttgagttaaattatttatgtttagttgttaaatttgtgttatgttgtgatgtttaattagtttttaatgtttttatgtttttattgaatattttttaggatgtttgaatattttttttttattattttgtttttttttttggtgtttgttttattaaaattagtgtatttgtgtagtttttatagattttaaatttaggttttaaattttttgtaatttttttgattttgagaagggttagagtttttatttataaatttatagaaataagggaaaaaatagatgttttaaattttttgtattataagtggaatatatagttaattgttttttttatggagttagattgtattttaaattatagttttgattatattttttttaaaagattatttaaatttttaaatatattagtgttttttattttttattatattttttttaaaataatatttaaatttttaagtttattagtgttttttatttttttgtaaagtagagaaagaataattttagttagtaatgtgaattttaggatttgtaaaaatttagataaaatgttgtagtttttttttttgttaaggtagaatatagaatttgattttttgttttatagggtttgggtaatagttggaggttattatttgtttattgttttatagaatatggtaaagtgtgtgattaatatgttgtgttagaaagggttttgtttgtttgtgtttgtttttgtttttaataaagtttgtaggaatatgttttttaaaaaaggaaaaatgtataggtatattgtaaatgttataggattttttgggataattttagataagatgttagtatttgtggagttgtttttattgatgttttttttggaatgttgtagaaagagtgaatttgttgtttaatttaaagagaggttgtagtagtaagttaggggatgttgttttttttttgtagattagaaagatattatttattttataaatttgattttaatttttgtaaaaaaataataataatatttttgggtttataggggaaaatttgagtaggaataaagtgtgtatattaatgtgagagttggagataaggaaatagaagaaaagggattaatataaattaattttaaagaatatgtaataatttagttagttataagtttaaatggttaaattttttattaaaattgtattttggttgggtgtggtggtttatatttgtgattttagtatttggggaggttgaagtaggtggattataaggttaggagattgagattattttggttaatatagtgaaattttgtttttattaaaaatataaaaattagttgggtgtggtggtgtgtgtttgtaattttagttatttttagtaggttgaggtaggagaattt

SEQ ID NO: 665 - DNA, 2942 bp, Artificial Sequence
  chemically treated genomic DNA (Homo sapiens)
tggttttttttgattatgtgggttattttagggaagttagtttttttagtgagttgagttgtatttttgttatttagtttatagatttttatttaggtagttttatggtttaggagatagtttatagttgttttttggtttgtttgagtagtatatattagtggggtttattagaaggtattttgggtgttgatattttttttagttttttttgttttatgtggttttagtagttttttaagttttggtaggttttttttttgggttgtttttagtatttggtgagttattttatttttagttttaagggattttttttgtttatgtttttttgatgttttttttgttattgtttttgttgttggtgtttttattattttttttttttttttttttttttttttggtaggtttagtttgagatttttgggagttaggagtgttgtttttatttttaattagggttttatagaaagtttgggttgtagttttatttagggtggattttggttttttgggttgtggttgttgttgtttatttttttagaggttgttggggttagtggttggggtgaaggtgatgagtaagggttgggatatggtttttgggagaattgagaaaatgatattaggtaagggaaggatgagataagtaagttaagtttgtggtgattttgtagtaattatagttttagagatttgttgggatgagaaaaagtagttaaaaatatttttttgttattaaagtaattttataatttaggattttgtagggtttaagggagagagattttgtgtaaaaatatggaattttataatattgattttgttttttagtaaagattaataaaattttatgagattgttgtttagaggttttgtgtttggtttttatttttatttttattaataataaatattagtttttttttgaaattatttttttattttgtaagatatattagtaggaaaaaaaaattagtttggttttttaagttttttgtgattttattttggagttttttttttttaaataaaaatagatgggttattttttagaagattttggggagagttttttatatgtgttgttgtgtagtttttgtattgtaaaatggtgttattttaattagaagagttgatataattaaatagttatatggtatgaagatgtatgtgtggtgataataataataaaaattataatttatattatttgagggtttgggtgtgtgtaaagttttgggtttagttttttgtgttggaatttttttaatagtaaatgagtaaagttttgtgtgtttaggtggtgtgagtattaggatttgttggttggggttttatttttatataatgtttttataatgttttttgttttttttaatgtggtttttgttttaagtttattttttggagttaggaatttattttgtgggttaggaaaggtttttaggaggtggagggaaatttgtggaatgttgagaagttgtgtaatgaaataatgttatgtttgttttttattattattttgattagggtttgaaggttatatttagagtttaaggggaaatggagaagtgtaaagggatgagtagaatggttggtattattttaggttagtgtattgggatgttttagtttttatattgtttattttattttatttaagtttttatgtatggagttaagttgtatttttttttttatgaggtaggagtttggaggaaatagtatgtttgttaagggtttttggtgggattgatttgtattaggggtttaataggtaataaggatttagtggattggttgaggataggttagttttttgggtagtagtgttgtgttgggattagaggggaatgtgaggagagttgtggaaagagatttagtttggtttttttttttttttgttttaagttagtttttttatttagtgagtataaaattgtattgtttagatttttgggttttgaatgttatatttggtttttgtttttggtggttttttgttgtgttttgtttgtaagtgtttttttttgggtttttgtgatagttaggttgtgtgtgggttattttgggattggtagtttgtttttttttatttagttagtttttttttttattggggattttgtgttttggtatttattgtggtatttgatttttggtgtttgtgtgttgtttttttttttattttttttaatttttattttttttattttattttgtttgttgtggttgggtttgtggtttgtgttgtagtggttgttgttgttttttggaagtagtaatttttttattttattttagttttggtttttgtttagttggtgagtttgaagttgttgttgttttgagttttttgttgttgggagtggtatatggggtttttggattttgatgtgggggtgggggaggaagtgattaggtttggtatgaaggagggagaggtggtttgaggagtggaggggggatgtgtggattttggtgaaagggatttgataattgtttttaatttgtgagaaaaggaggagtttggtttttgtttgagaatgataaatttggaaatttttgggaaaggtgtgggggttatgtagagatttgtattggtagggagtttgagttgaggtttttgttggagttgatatagaggagagagggttttggtttttgggagttttagggatgtgggttgggttggtgggttaaagtatttgttggttttttttaagtggtgggattttaaagaatgtttaattttaaagaaaaggggttgagatgtaaattagaggagttggagaggagtgttttagagtttgggttgttttaagaaagggtggttttgaatttttttgtggttggagggttgaatgtgggaggagggaggatattagaggtagggaaggagaatttgagttttattgatattgttttttttttagt

SEQ ID NO: 666 - DNA, 2942 bp, Artificial Sequence
  chemically treated genomic DNA (Homo sapiens)
gttagaaaaagaatagtgttagtaaagtttaagttttttttttttgtttttggtattttttttttttttatatttggttttttaattatgggagaatttggaattatttttttttaaagtaatttaaattttgaagtatttttttttagtttttttaatttatattttagttttttttttttgaagttaaatattttttggggttttattatttgaaagaagttaatagatattttgatttattagtttgatttatatttttggagtttttgaaggttagggtttttttttttttgtgttaattttggtagggattttgatttaggttttttattaatataagtttttgtatgatttttatgttttttttaagggtttttaagtttattatttttaagtaagaattgggttttttttttttttatgggttgggggtgattgttaggttttttttattggaatttatatattttttttttgttttttaggttattttttttttttttgtgttggatttggttgtttttttttttgtttttatattaaagtttggagattttatgtgttgtttttagtgataagggatttggagtagtgatgattttagatttattggttggatggggattaggattggggtggggtagggaagttgttatttttagggaatggtggtgattgttatagtgtaggttgtggatttgattgtggtaggtgaagtggggtggggggagtggaaattagggagggtggggaagagggtaatatgtaagtgttaagggttaggtgttgtggtggatgttgggatatggagtttttggtagagaaagaaattggttaaatgagagaaagtgaattattaattttaggatgatttgtgtatgatttggttgttatgaaggtttggaggagggtgtttgtgggtggggtataatgagaagttattggaagtggaagttaggtatggtgtttggggtttgggagtttgggtaatatagttttgtgtttattgggtgaagaggttgatttagggtggggaaaggaggaagttaggttggatttttttttgtagttttttttatgtttttttttagttttggtgtggtgttgttgtttaggggattggtttatttttggttaatttgttgggtttttattgtttgttgggtttttagtgtgaattagttttgttagagatttttgatgggtatattgttttttttgggtttttgttttatgaggggagaggtgtggtttggttttgtgtgtagggatttgggtggggtggggtgggtggtgtgagaattggaatgttttagtgtgttaatttgaggtggtgttagttattttgtttgtttttttgtatttttttatttttttttaggttttaagtgtgatttttgaattttggttagagtaatggtgaggggtaggtgtgatgttattttattatatggttttttggtattttataggtttttttttgttttttgagggttttttttaatttatagagtggatttttggttttagaaaatgggtttggagtgggggttatgttgaggaaggtgaagggtattgtgggggtgttatgtaaaagtaggattttaattgatagattttagtgtttgtgttatttgggtgtgtggagttttgtttgtttattattgaaaaagttttagtgtgggaaattgaatttggagttttgtgtatgtttgagtttttaagtaatgtgggttgtggtttttgttgttgttgttgttatgtatgtgtttttgtgttgtgtggttatttgattgtgttaatttttttgattagaatggtgttattttgtggtatggaagttatatagtaatatgtataggagattttttttgagattttttagggagtgatttatttatttttgtttgggaagaggaaattttgaaatgggattgtggaagatttaaagggttaggttgattttttttttttattggtatgttttatggggtgggaaagtggttttagaaagaggttggtgtttattgttggtgaggatgggggtgggggttggatgtaggatttttggataatagttttatggagttttattaatttttattaaggagtaaagttggtattgtagggttttatgtttttatgtaaagttttttttttttaggttttgtagagttttaagttgtggggttattttagtggtaggaaagtgtttttgattatttttttttattttagtaggtttttgaggttgtggttgttatagggttattatgagtttggtttatttgttttattttttttttgtttggtattatttttttagtttttttaaaagttatgttttggtttttgtttattatttttattttagttattgattttagtgatttttggaaggatgggtagtagtagttatagtttgagaagttagagtttattttggatggggttgtagtttgagttttttatgaggttttgattggggatgagagtagtgtttttgatttttagagattttagattgaatttgttagagaaagaaagagaaagaaaagaagaataatgaaggtattagtagtagaagtagtggtagaaggagtattaggaagatatggataagggagattttttgaggttgaggataagatgatttattggatattgagggtagtttaggagggggatttgttagaatttaggagattgttggaattgtatgaggtaggaggagttggggggaatattaatgtttgggatgttttttggtggattttattgatgtgtgttgtttgagtgggttagggggtagttgtgagttattttttgggttgtggggttgtttgggtgggggtttgtgagttgagtggtagggatgtggtttagtttgttgaagaagttggtttttttgaggtagtttgtatggttagggagagtta

SEQ ID NO: 667 - DNA, 13076 bp, Artificial Sequence
  chemically treated genomic DNA (Homo sapiens)
  unsure (1973, 2249, 2251, 9316): unknown base
ttttgttgtttaggttggagtgtagtggttggattatagtttattgtagttttaaatttttgggtttaagttattttttttttttagtttttatttttagttaatttttaaaaatattttgtagagataagggtttattttgttttttaggttggttttgaatttttggttttaagtgatttttttgttttggttatttaaagtgttgggattataggtgtgagttgtaatttagttgtttatttatttatttgtttaataaatatttattgaatatttgttttttggttagttaagggattttatgagtgtttattatgtgaataatattgtgttggttattagtttgttatttattggtggattagaaaaatagtgtgaggattattttttttttttttttttttttttttttgagatggagttttgttttgttgttaggttggagtgtagtggtataattttggtttattgtaatttttgttttttgggtttaagtgatttttttgttgtagtttttttagtagttgggattataggtaagtgttattatgtttggttaatttttttgtattttagtagagatggggttttattttgttggtaaggatagttttgattttttgattttgtgatttatttgttttggttttttaaagtgttgggattataggtataagttattgtatttggttaattttttttttaaattagttagggaggtgtgggtgggttgggtgaggagttgggtggggggattttatttagtatttaaatttttataagttttggggttgaggtgggtgatggtaagggaataggttttgttattattttttatagtgatttttatttgtgtaatatttttggtttattgagagttattattttatttgatttttatgattattttgtgaaggagtattaatagatattttgttttgattttattagatgtatgatttgttttatattaaattttataaatgatggatagaatggaggaattttttagattaagtgttgtttattttttattttaatggtggttttagtttgggtttatattatatgttttaaggagttttggaaaaaataaaggtttttggtttttttttgggatagtgtgattttttatgtttgagtaggtttatgaatttgtattttttagatgttttttaggatttgtgtttatttggattagggaattattatattatattattttgtgggaagatttagggggaagtattttagttatttttttgtgttttatagtattggagggtgttttgagtgggttgtgattaatttttaaattaattatatgtttttttttaatttttattgtttattttttgttttttagatatttattgtaggttggagatttttggaagttaatagtattgttgtagaatttatagggtttagtttttggtggattataaaatttaaattatgtggttggggaaagttgaaatttaagggaagggtttgaggaggggttgattttataataaaattggtttgtatttattaagtgttaattatgtgttaggtttttgttgatgttttaattttatgtgaaaagtattattattttttatttatagatgggaaaatagagatttagagtgtgaaaattatttttttaaggtgtatagattttaaagtttatgttattaggtataattttaaggttgtggtgtttttttatttgttttttagtttttaaattgttgttatgtttagggtttgatattttggtgttttttgggatgtgtttagatgtaggggtgtaaatgttaaaggagattaggttgtaggaagagaagggtagagtgttggatagtttggtttgttttttgttttttggggttgtggttggggaattataaggtttagtaggtagttgtagggggtggaggtggaggagggattagtgtgggtgggagtgagagagtgagttnttttgttttgttggtattagtttggaggtttttgtggttatagggtggtgtttttggtggtgggtggtattagtgggattgggattggtgtagttgtagtgtgtggaggaatttgggtgtgttgggagttgggtggttatgtttggatgggattgagattttttgtagtgtattgtgtgattttgttttttttggttgtgagtgtgttgttgtttgaaaagttgtggaatttaaggatttttttttggtttgagtttggggtgttttgtagtatgngntatttgtgttgtagttgggtatgttgtggtgttggggtttttgtagggtgatggagtttggtttgtaaggaaagtgaggtgttgtgttgtgttttggaggaggggggtataaggtttggagattttgggtggtggatgggagttttttttttgttttgtttttggggtattagttttggttttattgtttttgtttgggttggaggtgttgagtattgagtgttgttgggagttgagtgttggttgtggagtttttgtgattttgttaggatttgaatagagtttgggggtggtgggttggagttggggatgtgggtatatgtttgtttgtataagttatggtggatttttttgaggtggaatttttatgttgagtgaggtaagaattgtggtgtttttggaattagggtgggtttggtgttttgagtggtttttgtgttggatttttttggttgtgtgttttgtttgttgtagtttagttggggttggtgtttttttttgtttgttgtttgttttttttattttttggtttttttttgggtgatttgtgttttttgggtttttttttttttttttttgtttgtgttttttgtgttttttttttgtgtttgttttgttgttttttttgttgtttaattttttttttaatttgtgtttgggagttggtgaggtggtggtggttttttagtgagttttgggagggataggtttggggtgaaggtgtgaggtttgtggttttttggattggggaggagggtgggagtgggtggtgaggtgggatgtgttgtgtgtgttatgtgtgtgtgttgtattttattttatgtttttttggtttttttttggggatttatttttaatttagtaggtagttttgggtttaatgttaaaaatttggggtatttttaagtttttttttatttttgggaaagtttggggtgtgggttggggttggatggggtgggagatgaattgtggaggatgtggagggttaggttagttttttttggaataggttttaaggaggtgttgttattaaatggttgaatttgtttgagttgagagtgaaaaatgatttttttttttagaaggggtgattttatgatttggatggtttttgaaagggttggaagtttggggaatgggaggataatttatggttgttaagttgaggtgtgggatgggggtggaaggattgtttggttttaatttggtttttagaggtgggggaagggatgagggtttttgtttggtgtggtttatttggtagtgatgtgtatgtttttttggtttagatttttttgtattttgttttttttattgttatgtttggggttgggagaaaagtgaggttatgatttatgtttgtggaggaattttatggattttgtagatgggggtttatatagaatatatattttttatgaggtagttagatatttttttggtggtggtggggggggggtggggtgtgaagtttgttttttgttttgagtttagaagttattaatttttttgaaaaatattattatggtgttttttttttttagtatttttttatttttaatttttagatgtagtagttgtatttggttttgttttattttatatgggtatattgtagttgtattattaatttttttttttttttttttttttttttttaaattaaaatttagattttttagtttgttttgattatttttttttttaatatttttggagatttggagatgtggtgttgagatttgggggagaaaagaaagtttttttggattttgagttatttaagattttattaagttatttgttgttgttggtgggtggtggtggtttgggtgttttttggattgtgtagtaaagaggtattttgggagatggggttaaggttttagggggtgttatttgtgaatggtttatttgttagattaggggggttttttggttgtgtgtttggttagaattggttttgatgatggaagtttttggaattaaagtgttgtttttttttttttgtgttatagttggagttgtgggagtgtttgttttgtttggagtttgtggtttttttttggttgttttgtggtggtgttatgtgttttttttggagtaagtttggtgtgtagggttgggggtgtgggtggttgttgttagaggtgttttttgtgtgtttttaaggattgatttgggttgtattttttggaaattaaagtggggtgttttattgtttaaataatggttataggtttgaaagtggggttggatttttgagttgtgtttggtaatagtttttgaggtaggaaagtgttttgtggtttaaagttgttgggagggtggggagagttggtgttttatttgtttttttttagttttttttaaattgaaaatatttttttggtttttttttttgggtggtagttttggaggttgtaatgaaattgtattttttttagatgtggtaattaaggtgattgttttttttgtagatgtgttttattttttgtatttttggattagtgttttttttggaatattatttagttttgagattgtttagtagaaagtggttattttttttttttggtttgggtttttggttttttttttgaggtttgtttaaaagtgaagtagtagggttttgtgggatgtgttttggtttgggtaattatttttatgtttgggttatttattttttttttggtgattgaggtttagtagtttttgttattgttggttgtttttgttgatggtttgtttttttaatgatttgtttatatattttatttttagtgggttaggagaagttttggggttgttttgattttttgagtgtagggtgtttggggattgggaggttgttggggtttgattttagttgggagggttatgaattgtattagtgatgagttgtttgaaatatttgttgtatttatttttagttatagttgagtgttagttttttaatgaggtttatttagattgagagttatttggattgtgtattttattgtttgtttttttaaatatgtttgtagaaatgtttatttttgaggtattttttttaatgggaatttaggttagagtgggtattatttgaataattttagggtgttttttttttttggtttttggttatggagggtgttagatagttttattaggtggttttttgatagtaagggaagtaaaggtttaggaagaaatggagaagtgttttttattttttaggggtagaggattagatatattggtgtattttttaggttgggttagttttatttttggtggattttagagggtaagaaaattgaattgaatattgggtaggtagatttaagttttagagattaaggaaaatttatgggttttgtttttagtggtgtgttttttgtttttagtattgatttgaaataagatttttaaaatgagagatttgttggtatgaatttgggggtttagtagttggtttttataaaggttttttttttgtttttgtttttaaagtgttttttgttaaaatggttgttagttatagaatattttagtaaagtttgagtttgttgttgttggaggaaaaggagttagaattgatttaaatgttttattttgaaagggttttatattatttgatagtttaatttttttttgggaaatttgtgttttatatttgttttttttagagttttgtaaaaggtttgaatgtattagggattagtgggagtttagatgtagagttttagagaagattttggtgtttttagagaggatgaaatgttagatttgggttaggatatttgtttttttttttaaggttgtatttattttaaatagaaattttttttttgttattatttattttttttttgtaatgaaagaaattatgtttagggtttttttttttatttaatagtttttatatggatgaattattttaagaatttggtggggttttatttatagtatattttgtttttaagagtaaggttttttagattatgtgtagtagtttgtgttttatttgttgttttttttttttttttttttttttgagatagttttgttttgttgtttaggttggagtgttgtggtgttattttaggttattgtaatttttgttttttggttgaagtgatttttttgttttagtttttttagtagttgggattgtaagtatgtgttattatgtttggttaattttttgtgtttttaatagagatggtgttttattatgttggttaggttgggtttgaatttttgattttaagtaatttgttggttttggttttttaaaatgttgggattataggtgtgagttattgtgtttgattatttattgttaattttttatatgttttttatttttaaggatatttagatattttttttttttaaagagatttaaaaaattagtatttttattggattaattaaaatttagtaagttgagttgagtaattttttttatatgtttattaagtatttgttttttgtttttttaatatgtgagtagagaatggttattttggggaagaaataagttttatttttatttgaagggattaatgttttggtgttatttttttaattttgaagaattaagttgtttagaaatttttttagggttttttggattagagtttggttggttaataaggggtattatttaattgtttttttttgatatttttagtttttttttttggaggagtatttttgttagtttttttttattagttttttttttttttttatttatttatttatttatttagttaataaatatgttggtattttttgtgtatatgttaggtgttgagggtgttagtaaaggttagggaggtatagattttgttttgaaggagtttgtagttttgtggggagagaagagaatgaagaatataaataataattatataatatgatttaagtgttatgtgagaggggttagtaatgtggtttgtaaatttggaggaatgaaattttttagttagaaggtttaagaaagttttatggaagaaatagttttttaaggtggggtttagagaaaagggaagggttggtttgttgtagaataaggaatggtatgaagaaagttttgtatagaggtatggatgttgttttgagttgtggtgttttatagaaatagaatatgagtagttggttatagtggtttatgtttgtaattttagtattttgggaggttaaggtaggtggattgtttgagtttatgagatggagatgagtttggataatatggtgagattttgtgtttattaaaaaatatataaattagatgagtatgtttgtgtttattggtagttttggttatttaggaggttgaggtgggaggattatttgagtttaggaggtagaggttgtaataagttgtgattgtattattgtattttagtttgggggatagaggaagattttgtttaaaaaaaaaaaaaaaaaaaaagttaggtatagtggtttatgtttgtaattttagttttttgggaggttaaggtaggtggattatttgaggttaggagtttaagattagtttggttaatatggtgaaattttatttttattaaaaataaaaaaattagttgggtttggtggtttatgtttgtaattttagttatttgggaggtaggagaattgtttgaatttgggaggtggtggttgagttaagattgtgttattgtaattttagtttgagtgatagagtaagattttattttaaagaaaaaaagaaaggaagaaagaaatataatattataatatgagttatgtatatgtttagattttttagaagttatattggaaattaagttaaaagaaagaaataggtaaaaaaaatttttttttttgagatggagttttattttgttgttaggttggagtgtagtggtgtaattttggtttattgtaatttttgttttttgggtttaagtaatttttttgttttagttttttgagtagttgggattataggtgtgtgttattgtatgtagttaatttttgtatttttagtagagatggggttttattatgttggttaggatggtgttgattttttgattttgtgatttgtttattttagttttttaaagtgttgggattataggtgtgagttattgtgtttggttaatatttgttttttaattaatttgtttgtttagattttatttaatgtaattatatttttaaaatattattatttgaatatgtaattaatatagaaattattgatgagatattttatattttttttataataagtttttaagatgtggtgtatattttttatttatagtatatttgttagtattagttatattttaagtgtgtagtggttattgtgtgggttataggtttagaatataagatatgaagatggagagtgagaaatgtttttggaaaggttggaagtttttgtttttttgttgttaattattaaattttttgagagtgttattaaggagtgatttaaagtattatataaagagaattataaatattttaatattatatttgaaatttaaatgtataattttttatatttggttggtattttagagaggagagaatgggtatagttatttatattatttatttgagttttataattatttgtgatgtggttttttttaggtgggaaattgaggtttagaatggttaagtgattattttagggtggtaagattataagtggaagggtgtgaatttatattgtttttagtggataagaataaaaagatttaggttgggtgtggtggtttatgtttgtaattttagtattttggggaggttattgtaggtggattttttgagtttaggagtttattattagtatgggtaatatggtgagattttatttttattaaatatatagaaaattagtttagttttttgggaggttgaggtgggaggattatttgagtttgggggatggaggttgtagtgagttgaggaatgtgttattgtattttagtttgggtgatagagtaatattttgttttagaaagaataaaaagatttggttatgaatttgttagttagttttttttatataatttntggataaggagatttgatatttataggtttttttttagaagtgggagagttttaaggttatgtggtttgtttagtttttgttattttattagatattgtttattttgtatgttggattagtattttagtgagaagatagtaggtatttttatttatgtagtttatttagtttttataattatttgtgatggaggtaaggtaagtattttagttttttttgatgagtgggaaattgagatgtgttttttttttgttttttattgaggatttttgtatgtaggtatgaattttaggagtttagttgatattggagagatggggtggggggaattagttgtagggttttggaggaagttgttgtgtatatttgtaaggttgtaggttatatttatttgttaagtagtgaaggaaggaagttgtttttaagggattggaaaaatttattaattagtagaatgagaaattgaggtgaagtaggaggtggtagggttttagatagtatgttggattagtggtttgtgttattgtgttttttgtaggtgggtggtatggggtgtatgttgattttttattttaggagttggtgttaggaggttaggtttttttaatatttttgttttatagatgttaaatttgagggttagaggggtaggagaggaagagattttttgtattttttttgggaaagaataagagggaagttggtagatgaatttgaagtgtattgattagggagttgagagagggtggtttgtagttagtttatatttgggaggaggtggtaggtttttttggggatagagtggttaagttgaagtaagtttaattattttaatatgatattatttttttttattggaatttgagaatttgtttagtattttgatatttagtaagggatttgggtttttttggttaggtgtgtgtttttgggtgataggtttgtattaggtgtatttttgggatgtagtaagttgtggaatatgggtttaggggtattttttggtaagtattgtttttattttagttttgggaatgtgttttatgtagtgttttagatggtttatttgtggtttgtttttaagggttttttttttagttagttagttttgagatagagttttattttgttatttaggttggagtgtagtgatgtaattttggtttattgtaatttttattttttaaatttaagtaatttttatgtgttagttttttgagtagttgggattataggtgtgtattattatatttagttaatttttgtatttttagtagatgaggaattttattatgttggttagtttggttttaattttttattttaggtgatatttttgttttagttttttaaagttttgggattgtaggtatgagttaatatgttttggtataagggtttatttttgattaatggaattgtaaattaagttttttttgttattagagttattttggatttatttttatttatttggtttggataaattgagtttgtattagatggagttaggtttgattaattttttatttatttttttttattttgttttttaatatttaaaaattttgaggtattattatatgttagttatatttttttgagtaaagtatttaatttttttgagttttagtttttttattgtataaaaggaataataaaatttattttttataagtttatagtgaggaatgaattaattttttattatagttttaaattaattttatttagggtatttttggtatatagtgggtgtttagtatttattttatttttttttttttgattttttttgtaaaagtagaaaaatgaaagagaaatgttgattttttttttgatttgaaattattaaaatattttagtaagttttgggagggagttagtggtgtggtatgtgtattttgttggttaagtatatgtgaatgaagttaagaatttaggggtttttttgttagttagtattgatttatttgtgaggggttttgtttggtttgggggaggtagggttgaagtattatattagggtatgttttggggaagtagattttttgaataatttggatggttttttggagtatttaggatagaagttatttggaaaatagagatggttatttttatgtagttttgatagtgtttagaaagttttgttatttggtaaatgttaatagttatgatttgttttttaagattttggggagttttaagttttattttattagatttgagaagggtaaagggttgtagattttgtttttttaattggggttagtgtgagttatttttgatttagtgtttgtaatagattttgattttgtagtgggattttttaggtttttttgttttttgtaatttttggatttatatttgttagatattatttgttattttttagtattagggagaattggattttttttggttttatatttttaggttttttgtaagtagttggtgagggtttttttttttttgtaagggaggttggtagaattatggatgtgatttgtataattttagagataaaaagaaagtatttaggaggttatttattttagttgttttattgtataggttggggagttgagtatggagtttagtagttattaattagttatttttgtatttggtttttatttattggtttttagtttgttttgtgattttttattgttttttattttttattagagggattggttggttttagatggagtggtttttttaaaattttttttttaaattttttgagatagagttttattttgttatttaggttgtagtgtagtgttgtgattttggtttattgtaatttttgttttttgagtttaagtaatttttttgttttagttttttgagtagttgggattataggtgtgtattattatgtttagttaatttttgtatttttagtagagatgggattttattatattggttaggttggttttgaatttttgattttaaatgatttgtttattttagttttttgaagtgttgggattgtaggtgtgagttattgtatttggtttgggtagagtgaagttttatgttggggagttattagtatgtttaaattttttgtaattgtagtatattttgtaaaattgttttttataaaagggtagaattatttgggatttttatgagattatttattttgtagtatatattattttgaagtttatattttggaaaattttatgatggtatttttaggtttgtatgtaatttgtatttaaaatatagttgtagaattgaattaaagtatttttttgtttaattaagatttataatttttttttttgagatagaattttgttttgttatttaggttggagtgtagtggtgtaattttagtttattgtattttttgttttttggatttaagtgatttttttgttttagtttttgaagtaattgggattataggtgtgtgttattatgtttgggtaatttttgtatttttagtagagatggggttttgttatggttaggttggttttaaatttttggttttaagtgatttttttgttttagttttttaaagtgttgggattatagggtgtattattatatttagttaggatttatgatttaatttattgttggggtagttttataatttttttttggatgttttagtaagtttatattttaagtagttattatatggtatattttattttttgttttttttttttttttttttatttagatttttttaatttttggggttttttttttttttttagg

SEQ ID NO: 668 - DNA, 13076 bp, Artificial Sequence
  chemically treated genomic DNA (Homo sapiens)
  unsure (3761, 10826, 10828, 11104): unknown base
tttgaggaaaggaaaaaaattttaaaagttaggagggtttaggtaggggaggggaaaggaaaaatagaaggtaaagtatgttatgtggtggttgtttaaagtgtggatttattaaggtgtttagaagaaaattgtgaagttattttaataatgaattagattataggttttggttgggtgtggtggtgtattttgtaattttagtattttgggaggttgaggtgggaggattatttgaggttaggagtttgagattagtttggttatggtgaaattttgtttttattaaaaatataaaaattatttaggtgtggtggtgtgtatttgtagttttagttattttggaggttaaggtaagagaattgtttgaatttaggaggtgaaggatgtagtgagttgagattgtattattgtattttaatttgggtgatagagtgagattttgttttaaaaagagaggttataggttttaattggatagagggatgttttagtttaattttatagttatgttttgagtgtagattatgtgtaagtttgggaatattattatgaggttttttaaggtataaattttaaagtagtatgtgttataaagtgaatggttttatgaaagttttaaatagttttgtttttttgtgggaaatagttttataaagtgtgttataattgtaggaggtttgagtatgttgatggttttttagtataagattttattttgtttaggttaggtgtggtggtttatatttgtaattttagtattttgggaggttaaggtgggtagattatttgaggttaggagtttaagattaatttggttaatatggtgaaattttatttttattaaaaatataaaaattagttgggtatagtggtatatatttgtaattttagttatttaggaggttgagataggagaattgtttgaatttaggaggtggaggttgtagtgagttgagattgtagtattgtattatagtttaggtgatagagtgagattttgttttaaaaaatttaaaaaaaaaattttaaaaagattattttatttagggttaattagtttttttggtgagaaataaggggtaatgaagaattatggaataagttaaggattagtaaatggaagttaggtatagagataattagttagtagttgttggattttatgtttaattttttgatttatgtaatgaagtagttgaaataaatgattttttgggtattttttttttgtttttaaaattgtatgaattatatttatagttttattagttttttttgtagagagaagaaaatttttattagttatttataaagagtttaagagtgtggagttaggagggatttagttttttttgatgttggaaggtgataagtgatgtttgatggatatgagtttagaagttgtggggggtaagggggtttgggaggttttattgtagaattaaggtttattgtaagtattgagttaaagatggtttatattggttttagttaaaagaatagaatttgtagttttttattttttttaggtttggtggggtaaaatttaaaattttttagggttttaaagaatggattatagttgttaatatttattaagtgataagattttttgggtattgttaaggttatgtgggggtgattatttttattttttaggtggtttttgttttaaatgttttagggagttatttaagttatttagagaatttatttttttggaatatgttttaatgtggtattttagttttgttttttttgagttaggtagggttttttgtaagtgagttagtgttggttggtagaaaagtttttggatttttggttttgtttatatgtgtttggttagtgggatatatatgttatattattagtttttttttaaggtttattaaaatgttttaatgattttaaattaaaagagaagttaatattttttttttatttttttatttttatgaaaggaattagaaaagagaaaatgaaatgaatattgaatatttattatgtattaaggatgttttaagtagaattaatttagaattatagtgaggaattaatttattttttattataaatttatgggggataagttttattattttttttatgtaatggagaaattgaggtttaaagaggttaagtattttatttaaggaaatgtagttagtatgtaatagtgttttaaggtttttggatattagagaatagggtgggaggaagtaaataagggattgattaagtttgattttatttgatgtaaatttaatttatttaaattaagtagataagggtaaatttaaggtaattttggtaataaaagaggtttgatttgtagttttattggttaaagatagatttttgtgttagggtatgttggtttatatttataattttgggattttgggaggttgaggtgggagtattatttgaggtggggagttgagattagattggttaatatggtgaaattttttgtttattaaaaatataaaaattagttgggtgtggtggtgtatgtttgtaattttagttatttaggaggttaatgtatgagaattgtttgaatttgggaggtggaggttgtagtgagttgagattgtattattgtattttagtttgggtgatggagtgagattttgttttaaaattaattaattaaaagaaagatttttggaagtagattatagatgggttatttaggatattgtatggggtatatttttagagttgggatagaagtagtgtttgttagaggatgtttttaaatttatattttataatttattatattttgaaaatatatttgatgtaggtttgttatttagaaatgtatatttgattaagaaaatttaggttttttgttaagtgttagaatattgaataagtttttaggttttaatgggaaagagtggtgttatgttgagatggttaagtttgttttgatttggttattttgtttttagaaaagtttgttgtttttttttaggtgtgggttggttgtagattgtttttttttagttttttggttaatgtattttaaatttatttgttagttttttttttgtttttttttaaaaaaggtataaaaagttttttttttttttatttttttggtttttaagtttgatatttgtaaaataaggatgttaagaaaatttggttttttggtattaatttttggaataagaagttagtatatattttatgttatttgtttgtaaaaaatatagtgatataggttattagtttaatatgttgtttgggattttgttattttttgttttattttagttttttattttattaattaatgaatttttttaattttttagaaataattttttttttttattgtttgatagatagatgtaatttgtagttttgtaggtgtatatagtagttttttttaagattttgtagttggttttttttgttttgtttttttaatattagttaggtttttgggatttatgtttgtatgtagaggtttttggtggggagtagagagggggtatattttagttttttatttattagagggggttgaaatatttgttttgtttttattataggtggttatgaagattgaatgggttgtatgggtgaaagtgtttgttgtttttttattggagtattgatttaatatatagggtggatagtgtttggtgagatagtaggggttggatggattatgtgattttgaagtttttttatttttaagagaaaatttatgaatgttagatttttttgtttanaaattatgtaaggaaaattagttgatgaatttatggttaaatttttttattttttttgagatagagtgttgttttgttatttaagttagagtgtagtggtatgttttttaatttattataatttttattttttagatttaagtgatttttttattttagttttttgagaagttgggttaattttttgtatatttaataaaaatggggttttattatgttgtttatgttggtaatgaatttttgggtttaggagatttatttatagtggtttttttaaagtgttgggattataggtatgagttattatatttagtttgggtttttttatttttgtttgttggagatagtatgaatttatatttttttatttatgattttgttattttgggatagttatttaattgttttaagttttggttttttatttagaggaagttatattataggtgattatgaggtttaaatgggtggtgtgggtgattgtgtttatttttttttttttaaagtattaattaaatgtaaagaattatgtatttggattttagatataatattaagatatttataattttttttgtgtagtgttttgagttattttttaatagtatttttaggagatttggtaattggtagtagaaggataggaatttttaatttttttaaaggtattttttattttttatttttatgttttatattttagatttgtggtttatatagtggttattgtatatttgaaatgtggttggtgttaatggatatgttataagtaaaaagtatatattgtattttaaaaatttgttatgaaaaaaatgtaaagtattttattaataatttttatattgattatatgtttaaatgataatattttggaaatatagttatattaaataaaatttaaataaataagttaattaaaaaataaatattggttaggtgtggtggtttatgtttgtaattttagtattttgggaggttgaggtgggtaaattatgaggttaagaggttgatattattttggttaatatggtgaaattttgtttttattaaaagtataaaaattagttgtgtgtagtggtgtgtgtttgtagttttagttatttaggaggttgaggtaggagaattgtttgaatttgggaggtagaggttgtagtgagttgagattgtgttattgtattttagtttggtaataaagtgagattttgttttaaaaaaaaaaattttttttatttattttttttttttaatttaatttttaatgtggtttttagaaaatttgaatatatatataatttatgttataatgttatatttttttttttttttttttttttttttgagatggagttttgttttgttatttaggttggagttgtagtggtgtaattttggtttaattattgttttttgggtttaaatgatttttttgttttttaagtagttgggattatagatatgagttattaagtttggttaatttttttatttttagtagaaatagggttttattatgttggttaggttggttttgaatttttgattttaggtgatttatttgttttggttttttaaagggttgggattataggtatgagttattgtgtttggttttttttttttttttttttttaaatagggtttttttttgttttttaggttggaatgtagtggtgtaattatagtttattgtagtttttgttttttaggtttaagtgatttttttattttagttttttgaatagttgggattattagtaagtatgagtatatttatttaatttgtgtattttttggtagatatagggttttattatgttgtttaggtttatttttattttatgggtttaagtaatttgtttgttttggttttttaaagtgttgggattataggtatgagttattgtgattagttgtttatgttttatttttatagggtgttatagtttgaagtaatatttatgtttttgtgtaagattttttttatgttattttttgttttgtaataggttagttttttttttttttttgaattttattttaagaagttgttttttttataagatttttttgggttttttagttggagaattttatttttttaaatttgtaaattatattattagttttttttatatagtatttaggttatattatatgattgttatttatgttttttatttttttttttttttatgaaattgtaggtttttttagaatagggtttgtgtttttttaatttttgttaatatttttggtatttagtatgtatataggagatgttaatatgtttgttaattggatgaatgagtaagtgaatgaaggaaaaaaaagggttgatgaaaagaaattgatagagatatttttttagaaaaagaggttgagaatattagagaaaagtaattaggtagtattttttgttaattagttaaattttagtttaaagaattttgagaaaatttttggataatttggttttttagaattgaggaagtaatattaaaatattaatttttttagatgagaataagatttattttttttttaaagtgattattttttatttatatgttgagagggtagggggtaagtatttaataaatatatggagaaagttatttagtttagtttgttaaattttagttggtttaatggaaatgttaattttttgagtttttttaaaaaaaaaaagtgtttaaatgtttttggaagtaagagatatataaaaaattagtaataagtggttaggtataatggtttatatttgtaattttagtattttgggaggttgaggttagtggattgtttgaggttaggagtttaagtttagtttggttaatatggtgaaatattatttttattaaaaatataaaaaattagttggatatggtggtgtatgtttgtaattttagttattagggaggttggggtaggagaattgttttaattggaaggtggaggttgtagtgatttgagatagtgttatagtattttagtttgggtgatagagtgagattattttaaaaaaaaaaaaaaaaaaaaaaagtaataagtgaaatatgaattgttgtatataatttagaaaattttgtttttgaagataggatgtattatgagtggaattttattaaatttttgggatagtttatttatgtgagggttattaaatgggggagagggttttaaatatggttttttttattgtaggggagagataaatggtggtgaggagagaatttttgtttaaagtagatgtaattttaggaggaaaaataaatattttagtttaagtttgatattttattttttttggaaatattagaattttttttaaagttttgtatttgggtttttattagtttttggtgtgtttaggttttttataaagttttggggaagataaatgtaagatataaattttttaggaggaaattaaattattaagtgatgtgaggtttttttagaataagatatttgaattaattttaatttttttttttttagtagtaataggtttaaattttgttaggatgttttataattaatagttattttgatgaaagatattttagaaatgaaggtaagaaaaaagtttttgtagaagttggttgttaaatttttaagtttatattagtaaattttttattttaggagttttgttttaggttaatattgaaaataaagagtatattattaaaagtaaaatttatggattttttttggtttttaaggtttgaatttgtttatttagtgtttaatttaatttttttgttttttggagtttattaggaataaagttagtttagtttgagggatgtattgatgtatttaattttttgtttttagggagtgggggatgtttttttatttttttttgagtttttgttttttttgttattaaagggttatttaatggaattgtttaatattttttatggttagaggttaaggaaaagaagtattttaagattgtttaagtggtgtttattttggtttgaatttttattgggaaaaatattttgaaaatgagtatttttgtaggtatgtttggaaaagtaggtagtgaagtatgtagtttaagtggtttttaatttggatgaattttattaaaaagttgatatttagttatgattaagagtaaatgtaatagatattttaagtagtttgttattgatgtagtttataatttttttagttggagttaggttttagtagttttttggtttttaaatattttgtatttggagggttggggtagttttggagttttttttaatttattgggggtaggatatgtaaataagttattagggaggtaggttattggtaaagatggttggtaatagtagaggttgttgaattttggttattgagaggaaggtggatgatttgggtgtgggggtgattatttagattaaggtgtgttttatggggttttgttattttgtttttaaataagttttagggaggaaattgggagtttgggttaagggaggaaaatggttattttttgttaaatagttttaaggttagatagtattttaaaaaaagtgttggtttggaggtgtaaagggtagggtatatttgtggaggaaatagttattttaattattatgtttagagaaagtgtgattttattatagtttttaaaattattgtttaaagaaggaaattagagaagtgtttttaatttgaaagaggttggaaagaagtgggtaagatattgattttttttatttttttggtaattttggattataaggtgtttttttgttttaaagattattattaaatataatttgaaaatttaattttgtttttaaatttgtagttgttatttaaatggtaaaatattttattttagtttttgggggatgtggtttaaattagtttttaaaaatatatagagagtgtttttggtagtagttgtttatgtttttggttttgtgtattgggtttgttttgggaggggtgtgtgatgttattgtggggtagttgagaggggattgtgggttttgggtagggtaggtgtttttgtagttttagttataatataagggagagaaagtaatgttttggttttagaaatttttattgttaaggttagttttggttagatgtatagttaaagagtttttttagtttagtggatgaattgtttgtgagtggtattttttaaaattttggttttattttttaagatgtttttttattgtgtaatttagaaagtatttggattgttgttatttattagtggtggtgaataatttggtgagattttaaataatttgggatttaagggaattttttttttttttttgaattttaatgttgtatttttaagtttttagaaatgttaaggagggaggtggttaagataggttgaagaatttgagttttaatttgggggagggggaggggaggaagagggaagttaataatgtggttgtggtgtatttgtgtggggtgaaatggaattagatgtggttgttatatttggaaattgggggtgggggagtgttgggggagaaaggtattgtggtaatgttttttaaaagggttgatagtttttgggtttagaataagaaataggttttatattttattttttttttattattattaaaaaagtgtttggttgttttatagggggtgtgtgttttatatgaatttttatttataaggtttataaaatttttttgtaaatatgggttgtagttttattttttttttaattttaaatataatggtaggggaagtgaggtgtagaggggtttgggttagagaagtatatgtattgttgttgagtgaattatattggataaaaatttttatttttttttttatttttaggaattagattgggattgaatggtttttttgtttttattttatattttggtttaatgattgtgggttgtttttttgttttttaaatttttgatttttttagagattgtttaagttataagattattttttttggaaaggggagttgttttttgtttttagtttaagtagatttagttatttggtgatgatatttttttaaaatttattttaagagaagttaatttagttttttatgttttttgtagtttattttttattttatttgattttaatttgtattttaggtttttttgggggtggaaaaggatttaggaatgttttggatttttagtgttgagtttaaagttatttgttgaattgggggtgaatttttaaaaggggattaaaaagatatggagtggaatgtaatatatatatataatatatataatgtattttattttgttgtttatttttgtttttttttttagtttaggaaattgtgggttttgtgtttttgttttgggtttgttttttttgggatttattgaggagttgttgttgttttgttagtttttgagtgtgagttggaggaaaagttgggtggtgggaagagtggtgggatgagtgtagggagggggtgtaggagatgtggatggagggaagggaggggagatttaagaggtgtggattgtttgggagggagttaggaggtgaaaggggtgggtggtgagtggagggaggtgttggttttggttgggttgtggtgggtaaagtgtgtagttgggaggatttggtgtgggggttgtttgggatgttaagtttgttttagttttgggggtgttgtggtttttattttgtttggtgtggaggttttgttttgggagagtttgttgtggtttgtgtgagtgggtgtgtgtttgtgtttttggttttggtttgttgtttttgggttttgtttgggttttggtggggttgtaagagttttgtggttggtgtttgatttttggtggtgtttggtgtttggtgtttttagtttgggtgggaataatggagttggagttggtgttttggaggtggggtggggggagggtttttgtttgttatttggggtttttagattttgtgttttttttttttagaatgtagtgtggtgttttattttttttgtagattgggttttattgttttgtggaggttttggtgttgtggtgtgtttgattgtagtatgggtantntgtgttgtggggtgttttgagtttggattggagaaaagtttttgggttttgtggttttttaagtagtggtgtgtttgtggttggggaaggtgaggttgtgtaatgtgttatgaggggttttggttttgtttggatgtggttgtttagtttttggtatatttgggtttttttgtgtgttgtggttgtattggttttggttttgttagtgttgtttgttgttgaggatgttgttttgtggttgtaagagtttttgagttgatgttggtggggtgaagnggtttgtttttttatttttatttgtgttggttttttttttgtttttgttttttgtagttgtttgttgggttttgtagttttttagttgtggttttaaaggatggggagtgggttgagttgtttggtgttttgtttttttttttttatagtttggttttttttggtgtttgtgtttttgtatttgagtatgttttagagggtgttggaatgttaggttttagatatagtagtggtttgggggttagggggtaggtgaagagatgttgtagttttgaggttgtatttggtagtgtgggttttggagtttgtgtgttttggggaaatgatttttgtgttttaaatttttgtttttttatttgtaaatgggggataatagtgttttttatatagagttgaggtgttaatgagggtttagtgtatagttaatatttagtaaatataagttggttttattataaggttagtttttttttaaattttttttttggattttagttttttttagttatataatttaggttttgtggtttattgggaattggattttgtaaattttatagtgatgttgttggtttttagaagtttttagtttgtagtgaatgtttaggaagtaaagagtaagtagtgggagttgaggggagatgtgtggttggtttggaaattaattatagtttatttagaatattttttagtattgtggaatataggaaagtggttaaaatgtttttttttgagtttttttgtgaagtggtataatgtagtggttttttaatttagatggatatgggttttagggaatgtttgaaaaatataagtttatgggtttgtttagatatgaggaattatgttgttttaggaaggagttaagagtttttattttttttaaggttttttggggtgtgtgatgtgagtttaggttgaggttattattggggtgggaagtaggtagtatttggtttgaaggatttttttattttgtttattatttatgaagtttgatgtaggataaattatgtatttgataaaattaaaatggggtatttgttgatatttttttataagatggttataagaattaaataaaataatagtttttagtggattaaaaatattatataaatggaagttattatgaaaggtagtggtagggtttgtttttttattattatttattttaattttgaaatttgtagaagtttgaatattgaatgagatttttttatttaattttttatttaatttatttatgtttttttggttaatttaagaaaagagttggttgggtgtggtggtttatgtttgtaattttagtattttgggaggttgaggtgggtggattatgaggttgggagattgagattatttttgttaataaggtgaaattttgtttttattaaaatataaaaaaattagttaggtatggtggtgtttgtttgtaattttagttattggggaggttgtggtagaggaattgtttgaatttgggaggtggaggttgtagtgagttgagattgtgttattgtattttagtttggtaatagagtaagattttgttttaaaaaaaaaaagaaaagaaaagaaaaaatggtttttgtgttatttttttaatttattagtaggtgatagattagtggttaatatagtgttatttatatagtagatatttatgaaattttttgattggttaaagagtaaatatttaataagtatttgttgaataaatgagtaaataaataattaaattatagtttatgtttgtaattttagtattttgggtggttgaagtgggaggattatttgaagttagaagtttaagattagtttgggaaataaagtgagtttttgtttttataaaatatttttaaaaattagttggaggtggaggttgaagaaggaggatggtttgagtttaggagtttgaggttgtagtgagttatgatttagttattatattttagtttgggtgatagag

SEQ ID NO: 669 - DNA, 2451 bp, Artificial Sequence
  chemically treated genomic DNA (Homo sapiens)
agatttggtttatataatttagagttgttgttttgtgtttttatgttgtttttttagtttttttatttttattagtagttgatatttttgtagttgttttagagtagagggtttagtttttttaattttgtggtttttttatatttttaagaattattgagaattattaggaatttttgttaatgtggatgggttatatttagttatatttatatattttaagttaaggttaaggaatttaaaaatatttatttattgatttattttaagatagtgatgtatttattttatgttaatattaataatttatttttatggaaaaaaaataataaaatgaaaatagtgttttagtttatatttttgtaaatttttgtaatatttggttgaaatggagatagtgggagtttttttattgtttttgtatttgtagaattatattttatatttttgggagtatgagaatgagaagggtaagtaatatagagggttattagataaatggttttgattttatggattttttgaaaggaataggaagtttttaggggttttttgtattgaggtttttttgattaagggagttaagttttaagggttgttggggagttggaggaggtgagatggggtagagaggttgttgttattaaaagtgtgtttaggttttatttattttattttaggtggtttattgagtttatatggttattagtgtaattgaagtagattttgatagaattttgtgtagaattattttaggatttatttattttggtatgtataagttattttaattgaagaatgttttttaataataaaatattgtaaatttaagtatgtggtaatagtaatgattaagtaaattatggttttttgaagtttagtgttttgtagttattagagagtaaaagtgagaatgtgtttagtggagatagttttaggatatttaaaagtagagagtataaagtatagaattgtgttgtgtatgttatgatttttttttttgtgtttttgaaaaagagaatatatgtatagtaggaaaagatatattaaattattttatataattggttgtttttgtgtttggtaagatgtatgtattgaagaggaaggttttgattttttttttttttttttttttttttttgagatagggttttgttttgttgtttaggttggagtgtagtggtgtgattttagtttattgtagttttgattgttttggtttaagtgatttttttattttagttgttttagtagttagaattataggggtgttattatgtttggtgaattttttgtagagatgggttttttttaggtggtttaggttggttttgaatttttgggtttaagggatttttttgttttagttttttaaagtgtggggattattggtgtgagttattgtgttttgtttgtttttaatttttagtagttttaaattttttggtaatgagtaatgttatagtgttttagatgtttggttttttaagaaaaggatagtaggatgggttattttggtgggagtgtgttttatttttgttttttgttagttgtttttgttggggatgtatttaggtatttttttttggatgtgtgagtggtttgtttgtggatatgttagttttgttttgtgagtttggtttttttgttttttttttgtttatgttttgtgttttttttttattggttttatgttgtgtttttttgtttaattgtagtgtttagtgttagaatttgaatttttgtttttgtttgaattgggtgggtgtgttgggttggaagaaggaagtggagggttgatgttgtgggtgggtgggtgggtgggaggatttgatttggtgggagttgttagagttgggtgtttggggatgtagtttgtagggttattgggtttttgttagaggtggtggtgggagtagtggggattgtaggttggggtgtagtgaatgtgattttgtgggttgtggtttggtgtgtgtggagtgtggtgggtgtagtttattgggtggaggtgagtgtggtgttggttttttttgtggtggattttgggtgtgatttgatgagtggtggtttgataagtggttttgtgggttggattgttttaggtgagttgtggttgggatttttgggagttgtttggggttgagggttgagttgtggggattttttgagttttgtggggatgggtaggggatagatgtgtggtttgggtttgattttttttgggttttggtgagggtgttttggtggaagtttttaggaggtgtaggtgttggtgataatattttagttgttggattttggggtgttgggggttgtggttggattgttttggggtttttgttagttagttgtggtgtgtgtttttgtggttggggataggtgaattgggtatggggttttttttagtttttttgttattagagtaatttgtattttttttgtagt

SEQ ID NO: 670 - DNA, 2451 bp, Artificial Sequence
  chemically treated genomic DNA (Homo sapiens)
attgtaaaagaggtgtgagttattttgatagtaaaggagttaagaagggttttgtgtttaatttatttatttttggttatagaagtgtatattgtagttagttagtggggattttaggatgatttgattgtagtttttggtgttttaaagtttggtagttggggtgttgttgttagtgtttgtgttttttgggagtttttattgagatgtttttgttagagtttaggaggagttgggtttaggttgtgtgtttgttttttgtttgtttttgtagagtttggggggtttttgtggtttagtttttgattttggatagtttttaggagttttggttgtagtttatttgggatgatttggtttgtaaggttatttgttgaattattgtttgttaagttgtatttaaagtttgttgtaggaggagttggtgttgtgtttatttttgtttggtaagttgtgtttgttatgttttgtatatattgggttgtagtttgtggggttgtgtttgttgtattttggtttgtagtttttgttgtttttgttgttgtttttgatggggatttggtggttttataggttatgtttttgggtgtttggttttagtggtttttattgagttgagtttttttgtttgtttgtttgtttgtagtgttagttttttattttttttttttagtttggtgtgtttgtttaatttaaatgaaaatgaagatttaaattttggtgttaagtgttgtgattgaatgggaaagtgtggtatgggattaataggaagggagtgtagggtgtgggtggggagggggtggggaaattgggtttgtggggtggggttggtgtgtttgtgggtgagttatttatgtatttggaggaaaatatttgggtgtatttttggtgagggtggttggtggagggtagaggtggaatatgtttttattgagataatttgttttgttattttttttttaaaggattaaatatttgggatattataatattatttattgttagaagatttaaaattgttaaaaattaaaaataggtgggatgtggtggtttatgttggtaatttttgtattttgggaagttgaagtaggaagattttttgagtttgggagtttagaattagtttgggttatttggagagaatttatttttataaaaaatttgttaggtgtggtggtgtttttgtagttttagttattgggatagttgaggtgggaggattgtttgagttggggtggttgaggttgtagtgagttgagattgtgttattgtattttagtttgggtgatagagtaaagttttgttttaaaaaaaaaaaaaaaaaaaaaaaaaaaattgaaatttttttttttagtgtatatattttattaaatataaaaataattaattatataaagtagtttggtgtgtttttttttgttatatgtgtatttttttttttaaaagtatagaaaaaaaggttataatatatataatatgattttatattttgtgttttttgtttttaaatattttgaggttatttttattgaatatatttttgtttttattttttgatggttgtagagtattgggttttgggaaattataatttatttaattattattattgttatatatttaggtttataatgttttgttattagaaaatattttttaattgaaatggtttgtgtatgttaagatgggtgaattttaaaataattttatataggattttattggggtttgttttagttgtgttggtggttatgtgggtttagtaggttatttggggtgaagtgaatggagtttaaatatgtttttggtgataatggtttttttgttttattttattttttttagttttttagtaatttttggagtttggtttttttgattagggaggttttgatgtaggggatttttgaggattttttattttttttagagagtttataaggttaaaattatttatttaatgattttttgtgttatttgttttttttatttttatgtttttaagagtgtggggtgtggttttgtaaatgtagaagtagtgaggagatttttattgtttttgttttaattaggtattatagagatttgtaaaaatgtgaattaaagtgttgtttttattttgttgttttttttttataaaaataagttattggtgttagtatgaaataggtgtattattattttaaaatgaattaataaatgaatatttttaaattttttagttttaatttaaaatatataaatatagttagatataatttatttatattaataaaaatttttggtggtttttaataatttttaagagtgtaaagggattataagattgaaaagattgagttttttgttttagagtaattataaagatattagttgttgatggaaatagagaaattgggaaagtaatataaaagtataggatagtaattttaaattgtatgggttaagttt

SEQ ID NO: 671 - DNA, 3780 bp, Artificial Sequence
  chemically treated genomic DNA (Homo sapiens)
tttttgttgtagattgagagttgtgtttggagtagagagtagtgtatatttttttttaggttttgttttttatttggttttttgttattttttggttttttttggtttttgtgaatttttttaagtttttttaattatagggttagtttttattgttaggttttggaatatattgttttatttgttggtattttattttttttttttatttaaattttagtatttttttttattttggttgatttgtgatatttattaagttataagttgtatatgttattttttgtggaatttttttttttattttttttaattttagaagtggggagataatattggagttgtgttttaatagtgagttgataggttttatgttttatagtagagtgtttttttgttatagtattgttatagtttgtattatttttatttgtttatttgtttgtttgagttatgattgttttgtttagagttttatttttagtgattgagaggatttgttggaaaatgtttttaagatattgttaattataaatgattatggtgaaatttattaaattgtaatttttttatggtgaaatttattaaattgtaattttttttttgattttttttttaattatttgtttttataatttatatatatataaagtaattttagtagaatgaaataaatttatttaataattttgaaaaattttataaaaaagttttgtaatagaattatgtattttttattatttaagggttaggaatttattgtttttaaggaataagataattatgatgggttagttaattttatagatggaaggaagtttaggaggtttagttaatttagtgatagtaatatagtatataggttagttttgtgtagtggtaagtaagaaaagttagtatgaagaaggggaaatgtattttttgaagtttttgagtaagggtagaattaggatttaaatttagatttgtttataaatttagtgtttttttgataaaaaataaaaataaaaagtaaaagaagattaaaggaaatttaaagagaaagaaaatgattgttttttttgtaggatagttatggttgattagaggaggtaggatatgtttaaatttttttttttagtataaataaaaggttgatttggttatgagaaaagttatgtttatggttagtaatgtgatgggttaaagagtttatgtttttaaaagttttgtgttttaattattatatttattgttttttattttgttttttgataatttgaattttagttgttttagaaggttgtgttttttaaatttttttttttttaataagtgtttgtttgaaatgtttgttttttattgttgtaaagaaatagtattagaatataaatttaatttatttagtaaggttatttttatattttttgtagaaagggtatatttgttagtagttttgttatgagagtatattaaataaaggagatagggttatttataatttgatagatttattttattgttgtgtttagtttttattagttggaatgggatttaatattttgtatttgatttgattggttagtaatttagaattttttaaaagaggtaaaggtagaggaaaataaaggaaggaggaagtaatttgtggaatgttgagaaaggtaaaaatatttttaaataaggaagaggaataggttatgttttaatgtttgtttggattattataagtatgttagggtaaatatttaggttaagttgtaggagttaagaatataaagtatattgatttttttattatggttagtagatatttaagaatgttttttggtgtgattttattttgtgtggttgttttttggagtagtatttatttatttttgtttgtttttttttttatttaagtgtgtgttgttttttgatggaagatttgatggatgtggatatgagttttttgaggttttagaattatttttttggttgtgaattaaaggttgataaagattgttattttaaggtggataatgatgaaaatgagtgttagttgtttttaagaatggttagtttaggggttggtgtaaaggatgaattgtatattgttgaagtagaggtaatgaattatgaaggtagtttaattaaagtaatattggtaattttgaaaatgtttgtatagttaatggttttttttgggggttttgaaataatattattagtagttttaatgttgaagtgtggtttagggttagtgtatattagtggatagtatttagtagttgtggaggaagatgtagagttagaagatgaagaggaggaggatgtgaaatttttaagtatatttggaaagtgatttgtttttggaggtagtagtaagtttttatagaaaaaagtaaaatttgttgttgatgaagatgatgatgatgatgaagaagatgatgatgatgaagatgatgatgatgattttaatgatgaggaagttgaagaaaaagtgttagtgaagtaatttatataagatattttagttaaaaatgtataaaagttaaattagaatggaaaagatttaaaattattaatattaagattaaaaggataagaattttttaaaaaataggaaaaaaatttttaaaatattaaaaggatttagttttgtaaaagatattaaagtaaaaatgtaagtaagtatagaaaaaggtggttttttttttaaagtggaagttaagtttattaattatgtgaagaattgtttttggatgattgattaagaggttatttaagatttttggtagtggaggaagtttttttaagaaaatagtttaaataatttgttaaaaattttttgttatattttatttttgtaatagttgatatttggttgttttttttataatgtagagtgagaattttttttattgtgtttgataaatgttgtttaggttttattgttaagaatgtgttgtttaaaatgtttgtttagtttttaaagatggaattttattttttgtttggttttaagtatgtatggaatgttatgataggatatagtagtagtggtggttagatatggaatttgtggggagataaaaatatatttgtgaaataaaatttagtattttaataaagtaaaaaaaaaaagaatggtagtataggtttttaaataaatgttgtttgtaagataagttattatttatttttaattaaatggggaggaaagtttttgaagaggaatttgttttttttatatgttttatgtaggttaagtttatatggaattgtttgatatttggagtttgttttatttaatttttaattgattattttatagttttttttgttttttgaatatttttggatgttatttttatttgttttttatatagattgttagtattttatatgagaagtttaatttttagtggaaagtaaggtatatagtagggtttattgtaaatgtaatgtgaatgatttaatgatgatttaaatagttttatagaaagatttaattaatatttatgaagtaattgttaggtggtagttatttttatatgagttattaaatttttaaaattattttgttatgtagaagatattggtttattttttagatgataggaatgaggttaagaagagttaattaattttttaagattttatttttagtggggttgggatttgaattttggttttttggtattaaagttggtgttttttttatagatttgtgtttttgttggatttgtttagtataatttgattataggtggaagagttttgtatagagatttataatgattgaagaatttattg

SEQ ID NO: 672 - DNA, 3780 bp, Artificial Sequence
  chemically treated genomic DNA (Homo sapiens)
taataagttttttagttattataggtttttgtgtaaagtttttttatttatgattaggttatgttgagtaaatttagtaggagtataggtttgtgaaaagagtattagttttgatgttaagaaattagaatttaaattttagttttattgagagtggaattttgagaaattaattgattttttttgattttatttttgttatttgaaaaatgggttaatattttttatatggtaggatgattttaagagtttaataatttatatgaaggtaattattatttagtagttgttttataaatattggttgaatttttttgtagagttgtttaagttattattagattatttatattgtatttataataaattttattgtgtgttttgttttttattggggattaaattttttatatgagatgttagtaatttgtgtaaggggtaagtagaaataatatttaaggatgtttagaaagtaagagaagttgtaagataattaattggaagttgagtgggataagttttaagtgttaaatagttttatgtgagtttgatttgtatgggatatgtaaaaaaaataggtttttttttaaagatttttttttttatttgattagaaataaatagtaatttattttataagtaatatttatttaaagatttgtgttattattttttttttttttattttattaaaatattgagttttattttataggtatatttttgtttttttatgaattttatgtttgattattgttattattgtgttttattataatattttatatatatttaaaattaagtaaagggtggaattttatttttaaaaattaaataggtattttggataatatatttttggtaatagaatttggataatatttattaaatatggtagggaaagtttttattttgtattataaaaaggatagttagatattaattgttatggaaatgaaatatgatggaaaatttttaataaattgtttaaattatttttttaaagagattttttttattgttagagattttgaatagttttttggttagttatttggaagtaattttttatgtaattgatgaatttggtttttattttgggaagagaattatttttttttatatttgtttgtatttttgttttaatgttttttatagaattaggtttttttggtgttttaggagttttttttttgttttttgaaagatttttgtttttttgattttggtgttgatggttttgagttttttttattttgatttgatttttgtgtatttttggttggagtattttgtatagattgttttattggtattttttttttagtttttttattattaaaattattattattatttttattattattattttttttattattattattatttttattagtagtaagttttatttttttttgtggaagtttgttattatttttgagggtagattgttttttagatatatttaagagttttatattttttttttttttattttttgattttgtatttttttttatagttattaagtgttgtttattaatatgtattggttttgaattatattttaatgttaagattattggtggtgttgttttaaagtttttaagggaaattgttggttgtatagatatttttaaagttgttagtgttattttaattgggttgtttttgtaatttattgtttttgttttaataatgtgtaatttattttttgtattagtttttaaattgattgtttttaaagataattggtgtttatttttattattatttattttaaagtgataatttttgttagtttttagtttataattaaaaagatagttttggggttttagggagtttatgtttatgtttattagattttttattgggaggtagtatgtatttaggtaggagagaaggtggatgaagataaatgaatgttgttttagagaatagttatataggatggaattatattaggggatatttttaaatatttgttagttatgataaagaaattaatgtattttatgtttttagtttttataatttagtttaaatatttgttttggtatgtttataatggtttaagtaagtattaggatataatttgttttttttttttatttaaaggtgtttttattttttttagtattttataagttatttttttttttttttgtttttttttatttttgttttttttaaaaagttttaagttgttagttaattgggttaaatatagaatgttagattttattttagttgatggaaattagatatagtagtagggtggatttgttaggttataaatgattttgttttttttgtttggtgtatttttatggtaaaattgttggtgagtgtattttttttgtagaaagtataaaaatggttttgttgagtaaattaaatttatgttttagtgttatttttttatggtagtggggaataagtattttaaatagatatttgttagaggaagagggatttaggaggtataattttttagaataattgggatttgaattgttaggaaatagaataaagggtaataaatgtaataattaaaatatagaatttttaaaaatatgaattttttggtttattatattattgattataaatataattttttttatgattaaattagttttttatttatgttagaaagaaaggtttgaatatgttttgttttttttaattaattatagttgttttatgaaagaaataattattttttttttttttagattttttttggtttttttttgttttttgtttttgttttttattaaaaagatattggatttgtagatagatttgagtttgagttttgattttgtttttgtttagaagttttgggaaatgtatttttttttttttatattaattttttttatttgttattgtataaaattggtttatgtattgtgttgttattattaagttggttgggttttttgagtttttttttatttgtaaggttagttaatttattatgattattttattttttaaaagtaataagtttttgatttttagatgataagagatatatggttttattataaaatttttttgtaggattttttaaaattattggatgaatttattttattttgttggaattgttttgtgtgtgtgtgagttataggggtaaatgattgaaaagaaggttaaggaaaggattgtaatttagtaaattttattatgaaaggattgtaatttagtaaattttattatgattgtttatggttaataatattttgaaaatattttttaatggatttttttagttattaggggtggagttttgagtaagatagttatggtttaggtaggtaggtgagtaagtagaagtggtgtagattgtgataatattgtgatagggaagtattttgttgtggagtatagagtttgttagtttattgttaagatatagttttagtgttgtttttttatttttggggttaggaggaatgaaaggaggaattttataaaaggtggtatgtatagtttgtgatttggtggatattataaattagttagggtaagagggagtgttggggtttgggtagggaagggaagtgaggtattggtagatagagtagtgtgttttaaggtttagtagtgagagttagttttgtggttggagaaatttgaagaagtttataggagttagagaggattagggagtgataagagattaagtgagaggtagggtttgagggaggatgtgtgttgttttttgttttaaatataatttttagtttgtagtagagg

SEQ ID NO: 673 - DNA, 2515 bp, Artificial Sequence
  chemically treated genomic DNA (Homo sapiens)
gtgatagagtgagattttgttttttaaaaaaaaagaaaaaaatttaattattttattaaagaagatatatgaatgattaataagttattaaattaaaattttagtgagtatatatatatgttttgaagtagttaaattttaaaatattgttttatgtgtgtgtattttttagttaaaaaagtgtttgaaaatagtattattttgaaatttaaaattttaaattttttttttaaattaggtagtagtgttattggaagtaaaagagaagttattttaattgttaaagagtatttattaagaatttataataaatattatgtttaatgtttaaattttagaagaatttatattaaaagttaagaataagataggatatttatttttattattaagtaatattatattagaggatttaattaatgtaataaggtaataaataaaagataaaattgttataattagatattataaatatttaagaaaatttagggggatttatagttatatattaaatagtttagaaggagttttatatattattaatgaatattgagaataaaaaatagtttttaaaatttttttaatttataagggtaataaaatgtataaggtattaaaataaatgtaatgtgtatttgggtataaatatagtaatataatgaaaaggtttattggggaaaaaattatagggagaagggttaataatgtgaagaggtttttttgttatttggatttttggaaaaagatttgttggtttaggtatagttggatgtattatggaaagtggttttaataaatattggtattgtaataattgtgtatgttgatataaaaagagggagttaatgaatatttggttgattatttaataattgtttttttgttgaagaaatggttttgttggattagagtttaattgtggtttatatattaatgttgttataatagttagaagttttattaagaaatttgttaaattattaaaaagaggaaatgaattttttaggatatttggattgtttttttttaaaaatttagttttggttgggtgttgtggtttatgtttgtaattttagtatttggtgaggttgaagtgggtggattatgaggttaagagattgagattattttggttaatatggtgaaattttgtttttattgaaaatataaaaattagttgggtgaggtggtatgtgtttgtagttttagttgttggggaggttgaggaaggagaattatttgaatttgggaggtggggtttgtagtgagttgagattatgttattgtattttagtttggtaatagagtaagatttagtttaaaaaaaaaaaaaaaaaatttagtttgtatggtagtataatattaggtaaaagtatagattagttagattattggttaattttaatttttatgtgtttgagtttttttatttgtaatatggagatgatatagtaatagttgattttggattgttaaaggaattaagtggatatatgtaaagtgtttagaattgtgtttggtaagtagtaggttgtaatattgtgatataataaatatatatatttgatttttatttagtttttggtatagatttttagaaatttttgtaattttttgagtgataggggtgatagaaatattttttattagaatatttggttttggtttttgatataagagtttttaagatttttggaatttttaagtgataagagtgtatgatagtgagttaattggtggttgggattttttagataattttaggatgggggttattttttgaaagattaaggtatgattagaggtttgggatttgtagttttatgttttgatttttagagagggtaaaagggttggtgattgattaattattaattgttagtgatttagttaattatgtttaagtgatggtatttttattaaaaaataaattataggtttggagagtttttggtttggttaattttaattatatattaagaaggtgatgtattttaaattgtatgaagataaaaggttttgtgtttatttgggatttttttggatgttgttttgtgtatttttttgattgtttgtttatttgtattttttataataaagtagtaaatataagtaaagtttttgagttttgtgagttattataagaaatgattgaatttgggattttttttttggaagttgtttttttttataagggagagagttgttttttttttttttttgtgtgttaaatttttgtttttaaatttattttttgtgtgtattgtgtttttaattttgttggtgtgagatgatgaattttgggtattgattttagataataatgttattttatattggggattttgtttgggattttaaggtgtatttattgtaaaggtgagtaaaggggtggattttaattttgttttttgattttgaggtttttggtttttattttagaattaaattaaattaaatattgggtttttttttgtttttgtgaatgagaaaattttgttgttttttaagattt

SEQ ID NO: 674 - DNA, 2515 bp, Artificial Sequence
  chemically treated genomic DNA (Homo sapiens)
agattttagagaatggtagagtttttttatttatagaagtagaagggggtttagtatttggtttggtttgattttaaaatggaggttaagagttttgaaattaaaggatagagttgaggtttgtttttttatttatttttgtaatgaatgtattttggaattttagatgaagtttttaatatgaagtggtattgttgtttggggttaatatttggggtttgttgttttgtattaataaggttaaggatatgatatatatgaagagtgggtttaggagtggaggtttaatatgtaaaagaaaaaggagaatagtttttttttttgtgagagagagtggtttttgaaaggaaaattttaggtttgattgttttttataatggtttatagaatttagaaattttatttatgtttattgttttattataaaggatatagatgaataggtagttgaagaggtatatagggtaatgtttagaagggttttaggtgagtataggattttttgtttttatgtagtttgaggtgtattgtttttttggtatgtggttggggttaattaaattgaaagttttttaaatttgtggtttattttttaatggaggtgttattatttaggtatgattggttaaattattggtaattggtggttaattaattgttagtttttttattttttttggaggttgaggtgtggggttgtaaattttagatttttaattatgttttagttttttaggggatagtttttattttgaagttgtttaaaggattttagttattagttagtttattgttatatatttttattatttggagattttaaaggttttagaagtttttgtgttaggaattaagattaagtattttaataaaagatgtttttattatttttgttatttaggaaattataagggtttttggagatttgtgttaggaattggatgaagattaaatatatatatttattatattataatattgtagtttattatttgttaggtataattttaagtattttatatgtgtttatttaatttttttaatagtttaaaattagttattgttatattatttttatattatagataaggaaatttaagtatataggggttaaggttaattagtgatttggttagtttgtatttttatttgatgttgtgttgttatatagattagattttttttttttttttttagattgagttttgttttgttgttaggttggagtgtaatggtgtgattttagtttattgtaaattttgttttttgggtttaagtgattttttttttttagtttttttagtagttgggattataggtatatgttattttgtttagttaatttttgtatttttagtagagatagggttttattatgttgattaggatggttttgattttttgattttgtgatttgtttattttggttttattaaatgttgggattataggtgtgaattatagtatttagttaagattagatttttaagaaaaggtaatttagatgttttagaaggtttattttttttttttggtggtttagtaaattttttagtaaggtttttagttgttatagtagtattagtatgtgaattatagttaagttttagtttaataaggttatttttttagtagagaagtaattgttaaataattgattaagtatttattggttttttttttttgtattaatatatataattgttatagtgttagtgtttattggaattattttttatggtgtatttagttgtgtttagattagtaggtttttttttagaagtttagatggtaggggaatttttttatgttgttgatttttttttttgtaattttttttttaataaatttttttattatgttgttgtatttatatttaaatatatattatatttattttagtattttgtatattttgttgtttttataaattggaggggttttaaaaattattttttatttttaatatttattgatgatgtataggattttttttggattgtttaatatatgattgtaaatttttttgaatttttttagatgtttgtagtatttgattatgatagttttgttttttatttattgttttgttgtattgattaggttttttaatataatgttgtttaataatgaagatagatattttattttatttttgatttttggtataaatttttttaaagtttgagtattaaatatgatgtttgttgtagatttttagtggatattttttagtagttaaagtaattttttttttatttttagtgatattattatttaatttgaagagaggatttggaattttgagttttaaaataatattgtttttaaatatttttttagttaaaaagtatatatatatagggtagtgttttaaagtttagttattttagggtatatgtgtatatttattgaagttttaatttaatggtttattggttatttatgtattttttttggtaaggtaattaaatttttttttttttttttaaaagatagagttttgttttgttgt

SEQ ID NO: 675 - DNA, 3107 bp, Artificial Sequence
  chemically treated genomic DNA (Homo sapiens)
gtatggtggtttatgtttgtaattttagtattttgggaggttaaggtaggtagattatgaggttaggagattgagattattttggtgaatatggtgaaattttgtttttattaaaaatataaaaaattagttgggtatggtggtgggtgtttatagttttagttatttgggaggttgaggtaggagaatggtgtgagtttaggaggtagagtttgtggtgagttgagatgattgggttattgtattttagtttgggtaatagagtgaggttttgttttaaaaaaaaaaaaaattattatatgatattaagtaatgtggaaggtgatttaaagggggaaaggaatatagtagtgtaaaggaaggaggttgtagatggatttagaattttttttttatttttattaggtgaaagtttgagaaaattgtaatttttgtgtaggttgggtttgttttgtatatattggttttttagtgtttatttttaataatgttgataattttgaaaattatttgtagatattttgtaggttttattttaggaataatggttatttttttgggtagttgaagtaaaattaagtttaatgataagtaaatataattattattaaaattttttatttatgtttgttaaagtaatttaagtatgatttgagaaggattttgtattttatatttgagtttttgtggatgaattgtaatttagtttaataggtagataagattgaaaatttaatttaggagtatgtgtttttaataatagttgagttttggttaattttagtggttatattttaattatttatatattgttgagtgtttaaattgtgtttaaagaaggtaaaagttaatttgtaattaatttagttgtttttttgttttatttttaatttttgtatgttatttttttttttttgtttataaatatgttttgattatgaggtatttttggagtttttgaatttgttgtgattttggaagttgttttatttgtaaattatttattatttaattaaattgttttaaatttaattttgttgaagtttttttttaataggtttagaaaaaataatggtaaaaatgaatgaaaatttaataattttggaagtagaaaaggttgggggttttaataagtgtaaatagttttatttttatattttttttatggtaattataatttagtatattatatatatatttttttgttttttgtattttggtttagggtaaagttttttaaaataggtattgttaattagtgttattaagaaggtttggatgttgttttgtgggaatattttaaagaggaatgtttaaaaggaaaagggggatgggttgggagaagggtattaggtgggtattttaaaattatttttagggttataggtttaatttatttggttgtggatgttagagttgttatggtaagaaggaagtaaagttttttgtaataattaaagtttttagaagtagtgtgttttattgtttattagtgtgttgtgaagtttggtgtttatttatagggttttttttagtattgtttaggttttttgagtgttttagtatagtagtttggagtttgttggtttggtgattaagatatattttagggaatatgttatgtagtggagttttttttttggtattgtatagtaaaaggaaagggttgttgggtgtttgtgggttttgggtagttatagaagttattgtgttggtggggaggagggggattgatgtggtttatgttttgggtagttttattttttttgtttgtgaagggtttttgtttggtgggaggagagaggtgtgttttatttgggtttttttatatttgttgttgtttgggttgattttgtgggttttgtttggtgttttagttgatttttgtttagttttgggtttatgggtgtggttagtagggtgggttagggtggtggggtgtgatattgggaggaagtgtgggttgtttgtttgggtgtgttaaggaagttgtttaaaatgaggaagagttgtgggtttggtggttgaggttattttggtggtggttggagagtgaggaggagtgggtggttttgtgttgtgtttgtttttgttttatttggtgtaggtaggtgtggttgtgttttttatttggttgggattttttggtaaggagaggaggttatggggaatgatgtgttgtttttatgtttttttttgttttatttttattggttgaggtaaaagtgttgaaattatgtgaataaaatataggtgggttttgttagttttgtttttgaatttatttgtgtttgggatttagaagttgtgttgggagagaggggtttaggtttgggtggaggggatggaggttagattgtgtggaaagtgatttgggtattttagggtgtttaggtttttagggagtgtggaaagtgtggttgtggtttggtttttgggagatgtgggattgggattaggtatagtgtgaggaagttgattttggagttagaatatttttttttggttatttatatgaatttattggaaaatgttgtagtgtttattaaagttatttaaagtagaaatgtttagatgttttatgagtttagataaattttttattataaaaagaaatagtagttgtatttaaataataatttttttgaattattattaaaatttagtataattatttttgtggatatatttttattgttaagtaatttatttagttaatgaatttggagagtaagaaagttttatgtagtaaaatgtaaatttgagttaagagttaagggtgtttttttttgtttgtttgtttgtttttggtaatgtggttttaaaattttaagtttatttaaaaattatataaatgtaatttatttttttgttggaatgtttaaggattagaaagataattggagaagtgagagtttgaatttttttttatgttggaaatagtgttgtaaaatattttttgagttttgtttgatttagtaaagatttagttgaatttaagtagagtttaaagtattgtagtgtgtagtaaaaaaaaaaaagagttgaagatgttgtgttatatttgatttttggtattaaaaataaaaaaaggaattatttaattt

SEQ ID NO: 676 - DNA, 3107 bp, Artificial Sequence
  chemically treated genomic DNA (Homo sapiens)
ggattaaatggtttttttttttatttttaatattaagaattagatatggtataatatttttaatttttttttttttttattatatgttgtaatgttttgaattttatttgagtttgattgaatttttgttaagttaggtaaaatttaaaaaatattttgtaatattgtttttaatgtaaaaaaagatttaaatttttatttttttaattgtttttttagtttttgaatattttaataaaagaatggattgtatttatatagtttttaggtgggtttaaggttttggagttatattgttaaaaatagataaatagataaaaagaaatatttttaatttttaatttaaatttatattttattatataaaatttttttgttttttaagtttattggttaagtaaattatttgataatgaaaatgtatttataagagtaattatgttaaattttagtagtggtttagaagggttgttgtttgaatgtaattgttgtttttttttgtagtaaaagatttgtttaagtttataagatgtttggatatttttattttgagtaattttgataaatattgtggtattttttagtggatttgtgtaaatggttaaaggaaaatgttttagttttaagattgatttttttgtgttgtgtttgattttaattttgtgttttttgagggttgggttgtgattgtattttttgtgttttttgggggtttgggtgttttggggtgtttgggttattttttgtatggtttgatttttgttttttttgtttaggtttgagttttttttttttggtgtagtttttggattttgagtgtgggtaggtttaggagtgaagttggtggaatttatttgtattttatttatatggttttagtatttttattttggttgatgaaggtagaataagaaagggtatgaaagtagtgtgttgttttttgtaattttttttttttattagaaagttttggttgggtaggggatgtggttatatttatttgtgttaggtgaggtgagggtgggtgtagtgtggggttatttgtttttttttgttttttagttgttgttggggtggttttagttgttgggtttgtggtttttttttattttgggtaatttttttaatgtgtttgggtaggtggtttgtatttttttttagtgttgtgttttgttgttttggtttgttttgttgattgtgtttatgagtttggagttgggtgggaattggttgaagtgttgggtgaggtttgtggaattggtttaggtggtggtaggtgtagaggagtttgggtggggtgtgtttttttttttttgttggataagggttttttgtaggtagagaaggtggggttgtttgggatatggattgtattggttttttttttttttgttagtgtggtggtttttgtgattgtttaggatttatagatatttagtggttttttttttttgttatgtagtgttggggaagagattttattgtatggtatattttttggagtgtattttggttattaaattaataagttttaagttattgtgttggagtatttgggaggtttgggtagtgttgagagggattttgtaggtgaatattagattttatggtgtattagtgggtaatggggtatgttgtttttgaaggttttaattattataaaaggttttgttttttttttattatgatggttttgatgtttataattaaataaattaaatttatagttttaagaatggttttgagatatttgtttgatattttttttttaatttattttttttttttttttggatatttttttttaaaatgtttttataaaatggtatttagatttttttgataatattggttggtagtgtttgttttaaaaagttttattttaagttaaaatgtgagaagtaaaaaaatatatatataatgtgttggattgtaattgttatggagaaaatatagggatgggattatttatatttattggagtttttagttttttttgtttttagggttattggatttttatttatttttgttattattttttttaaatttgttaaaagaaaattttagtagaattaaatttaaagtagtttaattgagtaatgaatgatttgtgaatggggtagtttttagaattatagtggatttagagattttagggatgttttatggttagaatatatttatagataaaaaaagggaagtgatatatagaaattggaggtaaggtagagaaataattggattggttataggttggtttttgttttttttgaatatagtttgaatatttagtagtgtatgaatggttgaagtatggttattgggattggttaagatttagttattgttaaaggtatatatttttaaattaggtttttaattttgtttgtttattaagttaggttatagtttatttataaggatttaaatatagaatatagagttttttttagattatatttaggttgttttaataaatataaatggaagattttgataatggttatatttgtttattattggatttaattttgttttaattatttgaaaaaatagttattgtttttgagatggagtttgtagaatgtttatagatggtttttagagttgttagtattattggagatgaatattaggggattagtgtgtataaagtaaatttagtttgtataaagattgtagtttttttaggtttttatttgatggaaatgagggggaaattttagatttatttataattttttttttttatattgttgtgtttttttttttttttgagttattttttgtattatttagtattatgtagtaattttttttttttttgagatggagttttattttgttgtttaggttggagtatagtggtttgattattttagtttattgtaagttttgttttttgggtttatgttatttttttgttttagttttttgagtagttgggattataggtgtttgttattatgtttggttaattttttgtatttttagtagagatggggttttattgtgtttgttaggatggttttgattttttgattttgtgatttgtttgttttggttttttaaaatgttgggattataggtgtgagttattatgt

SEQ ID NO: 677 - DNA, 3283 bp, Artificial Sequence
  chemically treated genomic DNA (Homo sapiens)
gggttgtagaaatggtggttttattttttaataatttgggtattgtgaatattatttttttaaaggggattttttttggttattttgtttagagtagttattataatttttgagtgtttattgttagttgatatatattagaaaaatataaattttataaaagtagggattggtttgtttttttttttgtagggtttaggttttggtatatagttggtgtagaaagtgtgtagttttaggttttatttaagtttttagggtattatatttgggatttgttttgtatatttttatttttgttttttattggtattagtttttttgtggaatagtttgagtttttttagatatttaatgtttttttttaagtgttgttatgaagttagatttttattgttttggggtatttttttttagggatgggaagtatatgttgttttttttatgtgatttatattttattttggataatttggttattattgtagtttatttagatttgtttggattttgtttattttagttttagtttattttatttttttaaatttgattgatagttatttttaatagttttattataaattatttataaaaatggttttaattttgaagtttatttatggagagtatatttgttaggtgtgtggtagatatataggaagtataagatgaggtagtagatttagaggtaaatgatttttttttttttgtttagtggtgattgttagtattatgtttttttgggagaggtgagaaatttttttatgtaagtattggaatttttatagttaagagtggtaatagttttggttattggatttgggtttgttgaattttaatattttgtgattttatatttgggttgaatttttgttgagtatgatggaatttatatgttttttttttagtttttatttgtttgtatagttggaatatttggttgttttttttggagggatttagtatgtttagagtttagatgttggaattgttaaagtttagaggaaagagttttagttgtaaagtaagagaaatgggttggaattttagttttattttttaatgaatgtttttgatttttttttttttttttttttttgagatgtagttttattttattgtttaggttggattgtagtggttatgattttagtttattgtaatttttgttttttagatttaagtgatttttgtgtttgagttttttgagtagttgggattataggtgtgtgttattatgtttggttaatttttgtatttttagtagagatagtttttggttatgttggttaggttggttttgaatttatgattttaagtgatttattttttttggtttttgaaagtgttgggattataggtttgagttattgtgtttagttgtttttgattattaaaaaaaaattttttttttggtggggggaatgaagtgtttttttgttgtttaggttggagtgtagtgtagtgattttggtttattgtaatttttgttttttaggtttaagtgatttttttgttttagttttttgagtagttgggaatatgggtgttttttattatatttagttaatttttgtatttttagtagtgatggggttttgttatgttggttaaggttggttttgaatttttggttttaggtgatttgttttttttggttttttaaagtgttgggattataggtgtgagttattgtgtttggttaaaaaatttatgttttaaaaagattagttaagtgtagtagtgagaaggggggaaagagtagagtaaggagttatatttgttgtttttgattattttgaataagttatttaattttttgaggataagtttggagaatgggagagatagttatttatttgtagggttgttgggaggaataagtgatattatgagtgtgtgttaggtgtttgattatagaaggtgtttaattaatttgtaattattaattaattttttagttgttggtattatttgttatttattttttgagtgttgttaagttatgggtgtgttttgttagtgttttagtagtggtaaggtttttggttgttagtggtgaatttttttttttgagtatttttttttttgttgagatgaaatgtgattgggtttttttaagggttaggtgttgggatttaggtggtgtttaatggttggattagtagttgtttgtgttgatttgtataagaaggaattttgggtttttggatttgtttgtttggttatgttgttgtggttgttgtggggttgggttgtttgggtgttgtgttgttttgggttgggaagttgtgggagtttggttttaggttttgggttgtggagggtgtagtgttgggtttggttttttggtaatgtgtgttttggttttgttttttaggagtttttatgtgtttatttatttttggttttttggtttttggaatttgtttgagtttgaagtgttttttttgaggtgtgggattttttttttggttgtggttgggatgggggtggttattggttgttatttgggtgtgagattgtagtgagtgttgggggtgtttggttttggttttgggatggagagagggtttttaaagagtaggatggatatgttttgaatattttggtttaaatttggttttttgatttattttttgttttgatttttttgattttgggggtgatggggattgggagttgttttaagttgattttgtttatattttggtgttagtgtgggggaggggggttatgtttttggtgtttttttgttttttttgggagtggggatttatatagaaatgggttattgttatatttgggttttggtgtttgttatatggttgttgagagatgttttagaattatttgtgggatggatgggtagtgatgtttgttttgggtttagaggaatatttgggttttaggtttaaaattatgtttgttgtttatttttttttgtgtattgtgagtggaggttgttttgtttttttatttgtttaatatttagtttgtgaagatttaaataaataatgtggaaaatgtaaagtataatgtattaagtgaaagaatttgagtatattgggggtttatgaagttgtagttgtagtttagggtggtatattggtgagatggtggtgtgtgtttttaattttggagggtgtttaaaatggaaaatgtttttaggttagggagtgagtataaatattagtgtttttgtggttatgtagtaaattagggtagaggagagttatttaaaagtgagtttaaaaattgatttttttttttttgtaga

SEQ ID NO: 678 - DNA, 3283 bp, Artificial Sequence
  chemically treated genomic DNA (Homo sapiens)
tttataaaagaaaggaaattagtttttaaatttatttttaaataatttttttttgttttaatttgttatatgattataaaaatattaatgtttatgtttattttttggtttaaaaatattttttattttgggtgttttttgagattggaggtgtgtattattgttttgttgatgtgttattttgggttgtagttgtagttttgtggatttttagtgtgtttgagtttttttatttagtatattatattttgtattttttatgttatttatttagatttttatagattggatgttaagtaagtggaaaggtagaatagtttttatttgtggtgtatggggaagagtgggtggtggatgtggttttgggtttgggatttaggtgtttttttaggtttagggtgggtattgttgtttatttgttttataggtggttttgaggtgttttttaatagttatatggtggatattagaatttgggtgtaatagtgatttgtttttgtgtgggtttttatttttagggagggtaggagagtgttgggggtgtaattttttttttttatgttggtattagagtgtgagtagaattggtttaaggtagtttttagtttttattgtttttaaggttgaaagaattgggataggaaatgggttgggggattgagtttgggttggaatgtttagagtgtgtttgttttgttttttaaaggttttttttttattttagaattaaagttgagtgtttttagtgtttgttgtggttttgtgtttgggtaatggttgatggttgtttttgttttagttgtagttggggaggaaattttgtgttttggaagaggtgttttgggtttgggtgggttttggaagttgaggggttgggagtaggtgggtgtataggggtttttgggaggtgggattaagatgtgtgttattgggaggttaggtttggtgttgtattttttgtggtttggggtttgaggttgggtttttgtgattttttggtttaaagtagtgtagtgtttgggtggtttagttttgtagtggttatagtagtatagttgggtgagtggatttagaggtttggggtttttttttgtgtgagttggtgtggatgattgttagtttagttgttgggtgttgtttggattttggtgtttggtttttaaagagatttggttgtattttattttagtaagaggagaaatatttgaagggagaggtttgttgttggtagttagaagttttattattgttaggatgttggtagaatgtatttataatttggtaatatttggaggatggatggtaaataatattagtgattgaagggttaattaatgattgtagattaattgaatattttttgtaattagatatttggtatatatttatgatgttatttattttttttaataattttgtaaatagataattgttttttttattttttgagtttgtttttagagaattaggtaatttgtttaaaatggttagaagtaatagatataattttttgttttatttttttttttttttttattattgtatttgattagtttttttaaaatataaattttttggttaggtatggtggtttatgtttgtaattttagtattttgggaggttaaggaaggtagattatttgaggttagaagtttgagattagttttggttaatatggtgaaattttattgttattaaaaatgtaaaaattagttgggtgtggtggggggtatttgtatttttagttatttaggaggttgaggtaggaaaattgtttgaatttgggaggtagagattgtagtgagttgagattattgtattgtattttagtttgagtaatagagggatattttgttttttttgttaaaaaaaaaatttttttttaatgattagaagtggttgggtgtggtggtttgggtttgtaattttagtatttttggaggttgaggaaggtagattatttgaggttatgagtttaagattagtttgattaatatggttaaaaattgtttttattaaaaatataaaaattagttgggtgtggtagtgtatgtttgtaattttagttatttaggaggtttaggtatgagaattgtttgagtttgggaggtggaggttgtagtgagttgagattgtggttattgtaatttagtttgggtgatagagtgagattatgttttaaaaaaaaaaaaaaaaaaaaaaattagaagtatttattaaggggtgaagttagaattttagtttattttttttgttttgtagttggagtttttttttttgaattttgatagttttagtgtttagattttaaatgtattagatttttttagaggaggtaattaaatattttaattatatagataagtaggggttagggaggaagtatgtaaattttattatatttagtaaaaatttagtttagatgtggagttatagagtattagaatttaataggtttaagtttagtaattggagttgttgttatttttgattgtgaaggttttagtgtttgtgtggaggggttttttattttttttgggagggtgtgatgttggtagttattattaggtagggagaaggaagttatttgtttttagatttgttgttttattttgtgttttttgtatatttgttatatatttagtaagtgtgttttttgtaaataaattttaggattaaggttatttttgtgagtgatttgtgatgaagttgttggaggtaattgttgattagatttaaaagaatgaaatggattgaagttgagatgggtaggatttaaatagatttgaatgaattatggtgatggttaaattatttaagatagaatgtaaattatataaaaggagtgatatatattttttatttttaaaaaggaatgttttaagatggtggagatttggttttatggtagtatttgagaaaaaatattaagtatttgaagggatttaggttgttttatggaagaattagtattagtgggaggtaaaagtaaaaatatgtagaataagttttgagtgtgatgttttgggggtttggataggatttgaggttgtatattttttgtattaattatgtgttagaatttgggttttgtagggagagaagtagattagtttttgtttttgtggaatttgtatttttttgatatatattagttagtaataaatgtttagaagttatggtggttgttttagatgggatgattaaaggagattttttttaaggaggtgatatttataatgtttaagttgttgggagatggggttgttatttttatagttt

SEQ ID NO: 679 - DNA, 3197 bp, Artificial Sequence
  chemically treated genomic DNA (Homo sapiens)
attagtgtttttaaagatagaagatggttaggtgtggtggtttatgtttgtaattttagtattttgggaggtttaggtgggtggattatttgaggttaggagtttaagattagtttggtgaatatggtgaaattttatttgtattaaaaatataaaaattagttagtgttgtggtatttgtttgtagttttagttatttaggaggttgaggtagaagaattatttgaatttgggaggtagaggttggagtgagtttagattaggttattgtattttagtttgggtgatagagggagattttattttaaaataaataaataaataaataaataaaatatagaagatgtatagtaaaaatatggtaattgtttttgtttgtttgttttgagatagggttttgttttgttatgtggattggagtgtagtggtattattaggtttattgtagttttgatttttttggtttaagtgttttttttattttagttttttgagtatttgggattataggtttatgttattatgtttggttaatttgttttgaattttagtagagatggggttttattgtgttgtttaggtttgttttagttttttggttttaagtaatttttttatattagttttttaaagtgttaagattatagatgttagttattgtatttagttagtaatataattttatgggattatttttatatttgttgttttttgttgatttatatatttttatgtaatgtatgattgttattattattattatttttattttttagatggggaaattgaggtataaagaatttaatttgtataagtttatttgtttagtgatggaataaagatgtgaatttaggtagtttggttttaaagtttatatgtttaataattatattagattattagattgttttttttttttttttttttttttttttgagatggagttttattttgttatttaggttggagtatagtggtgagattttggtttattgtaatttttgttttttgggtttaagtaatttttttgttttagtttttttagtagttgtgattataggtgtttgttattatatttagttaatttttgtatttttagtagagatggggttttattatgttggttaggttggttttaaatttttgatttttggtgatttttttattttggttttttaaagtgttgggattataggtgtgagttattatgtttagtttagattgttttatttttgtatttgtatttatttatttatttattttgagatagggttttgttttgtagtttaggttgaagtgtagtggtgtaatttagtttattatagtttttatttattggggtttaaaggatttttttgttttagtttttggagtagttggggttataggtatgtattattatgtttagttaatttttaaatattttttggtagaagtagggttttattatgttgtttagattggttttaaatttttagttttaagggatttttttgttttggttttttaaagtgttgagattataggtatgagttatgtatttagtttttttttaaaatttttttgagagataagattttgatttgttgtttaggttggagtgtagtggtgagattatagtttattgtagttttaatttttgggtttaagtattagattttttttattatattttattttatatgtgtgtggttttaattttgtttttgttattttttagttgtatgttttaatttaatttgtttggttttgttttttttaatagaaggatggttttggttatgggttatagttagtaatgtttaagtattagggttggtgagtgttttgttgtggtatggttttagtgttgtgtttttgaatttatttgttttttttaatgagagaaggttttagatgagggttgaattttttttgttttgtttatggtttttgaatgttgggggaggagtgtatggggaggggtggtttttaaatgggttattgttattaatagagattttaaatattgtttgttaaaaatatttgattggaggagtataaaagtgtagttgagtttagtgttttgtatttttttgagtagatgtttagagtagagttagttagtatgattgagtgttgtgttttttttttgtttttgtggggttttagttgggattttttttgtgattggtatttgtatagttgtttttttgattaggtttttgggttgttttggttgttggaggagtggttgtagtggttaggtggtagtagttggttaggttatgtgtgttttttgttttttgttgttattgagagttttgtagtggttgtgtttgtttatagttgtgtgtttagttggtaatttagtagtggggttttggagatttggtatattgtggattgttggtgtgtgtttttggatgttaattattttgttttggatgagttgatggttaagattaaggatggtgtggtggagattattggtgagtttttttgtttttgtaggggagaggaggaggttagtagggtgggtagggttgggggtgtgtggttgaaatgggggttttgggggtttggggagttaaatgttggtttagtattgggaaaaataggatttttgatttttttgtttaggaattgggagtgtgggttgtttttaagggtgttttttgttttgtaattttagtgttttgggaggttgagatgggaggattgtttgaggttaggagtttaagattagtttgggtaatatagtgagatgtgtttttttgttttgattttgtgttattataaaaaaaaagtaaataaaaatttttttaaagattattgatgaagagagaaaatgtgtttttttatagagttttttttttatttatagttttatttttagataagtggggagttttttggtgtggtgttagtttttagttgttgagtgggtgtgtgtgtggttttaagtgtgtttgtgtattgtttattttttagttttgtgttttgttttgttttttttaaaattttgaattgaagaattttttggaagtttttgagagtttagattggtgggtatgtttttatttttaattttttttgttaatttttattagtttgtagttttggttgtttttaagtaggaggtggggtttttggtttagtggggttgaaaggtagtttttttttttgtagtttgattttttttttttttttaaagg

SEQ ID NO: 680 - DNA, 3197 bp, Artificial Sequence
  chemically treated genomic DNA (Homo sapiens)
tttttggggggaagagggaaattagattgtgggggaggggattgttttttggttttgttaggttagaggttttattttttgtttggaagtagttaggattgtaggttggtagggattaatagagggggttggggatgggggtgtgtttgttggtttgggtttttagaaatttttggaaagttttttgatttagagttttgggaggaatggagtagggtgtggagttggggagtgagtagtatgtaggtgtatttggagttgtgtatatgtttatttagtggttagaaattggtattgtgttagggaattttttgtttatttggggatggggttgtgggtgggaaggggattttgtagaaaagtgtattttttttttttattgatgatttttaaaaaaatttttgtttgttttttttttgtaatggtgtggggttggggtgggggggtgtgttttgttatgttgtttaggttagttttgaatttttggttttaagtgatttttttgttttggttttttaaagtgttgggattatagagtagaaagtgtttttagaagtgatttgtatttttaatttttgagtaagggaattaggagttttgttttttttggtgttgggttaatgtttaattttttaggtttttgggatttttgttttaattgtatgtttttggttttgtttgttttgttagttttttttttttttttgtaggagtaggggggtttattggtgatttttattatgttatttttggttttgattgttagtttgtttggggtgaagtggttgatatttagggatatgtgttagtggtttgtagtgtgttggatttttgagattttgttgttgagttgttggttgagtgtgtggttgtaggtgggtgtggttattgtggggtttttgatggtggtggggggtagggggtgtatgtagtttggttagttgttgttgtttaattattgtgattatttttttggtagttggggtagtttgaaggtttggttgaagaggtggttatgtgggtattagttgtggaaggggttttagttggggttttgtaggagtgagaaggggatgtggtgtttggttatgttggttgattttgttttggatgtttgtttagaaaagtgtggggtgttgggtttggttgtgtttttatgtttttttagttgggtatttttagtaggtggtgtttgaggtttttattaatggtaatgatttgtttgagggttgtttttttttatgtattttttttttagtgtttaggggttgtgggtggggtgaagagggtttagtttttatttggaatttttttttgttaaggaaagtaaatgaatttgagagtgtgatgttggagttgtgttatggtagggtatttgttggttttggtgtttaagtgttgttggttgtggtttgtggttagggttgtttttttgttaaggaggatagagttagataggttgggttggggtatataattgagaagtggtagaggtaggattggaattatatgtgtgtgagatagaatgtgataaaaggagtttggtgtttgagtttaggagttgaggttgtagtgagttatgattttattattgtattttagtttaggtaatagattaaagttttgttttttaaaaaaattttaaaaaggggttgggtgtatggtttatgtttgtaattttagtattttgggaggttaaggtagaagggttttttgaggttaggagtttgagattagtttgggtaatatagtgagattttatttttattaaaaaatatttaaaaattagttgggtatggtggtgtatgtttgtggttttagttattttagaggttgaagtaggaggattttttgaattttggtgagtagaggttgtggtgagttggattgtattattgtattttagtttgggttatagagtaaaattttgttttaaaataagtaaatgaataaatataaatataaaaataaagtagtttgggttgggtgtggtggtttatgtttgtaattttagtattttgggagattgaggtgggaggattattagaggttaggagtttgagattagtttggttaatatggtgaaattttatttttattaaaaatataaaaattagttgggtgtggtggtgggtgtttgtaattgtagttgttggggaggttgaggtaggagaattgtttgaatttagaaggtagaggttgtagtgagttgagattttattattgtattttagtttgggtgatagagtgagattttattttaaaaaaaaaaaaagaaaaaagaaaaaagtaatttagtaatttggtgtggttgttaggtgtgtggattttgaagttagattgtttgaatttatatttttgttttattattaagtagatgaatttgtgtaagttagattttttgtgttttagtttttttatttggaaaatagagatgataatgatggtaatagttatgtattgtataaagatgtgtaagttagtaagggatagtaaatatgaaggtggttttataaaattatattattggttgggtgtagtggttgatatttgtaattttagtattttgggaggttgatgtgggaggattatttgaagttagaaggttggaataagtttgggtaatatagtgagattttatttttattaaaatttagaataaattagttaggtatggtggtgtggatttgtagttttagatatttaggaggttgaggtgggaggagtatttgagttaaggaggttgaggttgtagtgagtttgatggtgttattgtattttagtttgtatgatagaataagattttgttttaaaataaataaataaaaataattattgtgtttttattgtatattttttatgttttatttatttatttatttatttattttgagatggagtttttttttgttgtttaggttggagtgtagtggtttgatttaggtttattttaatttttattttttaggtttaagtgatttttttgttttagttttttgagtagttgggattataggtaagtgttgtgatattggttaatttttgtatttttagtatagatggggttttattatgtttgttaggttggttttgaatttttgattttaagtaatttatttgtttgggttttttaaagtgttaggattataggtgtgagttattgtgtttggttattttttatttttagaaatattaat

SEQ ID NO: 681 - DNA, 3155 bp, Artificial Sequence
  chemically treated genomic DNA (Homo sapiens)
ttttgagttatttatagaggtgattaagatagaaatgtgtgttattttttatttattttattgttattaattatatgtatttattaaattatgttagttttatttttttaataattgtagtttaatatttgaataattgaataaaaatttataatttaatttttttaatatttatttattttaattttatttttataatttatatataatttataattatttttatataattggtatagtgataattttagataaaatttattgaatttttatttttatttttgttaatgatatatatatataatgtaatgttgagagggttgggaaggaagaatgggagaaaggtagaagttgatagttaaaaaaaaaaagtttttagatggtttttttagtgttatttttgtaattttattaaataagggtttaaaatttatgttataatatttgtttgatgttttatttaaattgttttattggatattttttatttgttaagttttttgaaagaaataaaattgttttgttatagttagattttatgattttatatatttataatgggtagattttgtaggggtttatattttttaaggtggtttgggaaaatgatatagaaaagttttatattagttgaaaagaaaaatgtataatttattttggtaattttagttttaatttttaataggataaaggaaatatgtatattataaattaatgttttgtgttaataaataattaagtaagtagagttgtaagtattggttaaaatgaattttggatatttttagttattaaattttttgaggtaaggtagatatatatttggatttgaatatttgtattattagggaatttttgtttgtttgttttatattgttttgttatttttaaaagtaggtgttaaattaggttatttgttgtttgggtaatgttattttttgttataattataaattgaagaaaattgattgttttttttttttagttaatatgttgtgtttttagttttaaatatttttgagaagttgtttagatttatgagtaatgtttttgtttttaataggttaagatattaggtaggtttttgtatttttggagtttttagttttttgtaaagtgaggaagttagattaagtaattgttaggtttttttttagattgattaatttgatggtattagatgtaattgtttttgaattagggtatgaaatgaatttagttttggtgtattaatgtgatgattttgttttattaaagtttgagtatgtgataggtttagtattattttatatagagataaagggtaattttttgtttttaaaggaatgatataatttgtttttgaagtgatttatattatttttatttttgaataatttaatgtttagaaaataatttaagaatttttgttgattttagggatgtaagatatggttttttgatagtatttgggattgtggaaaaaagtaattgaggaaagggtatttttataatgtaatattgaatttagtgtttaaggtttattataggaatttttaatgatttttataattttttttttttttttttttttttttttttattttgaaaataaattgagaagttagtattgggataattattttttttgatttaaataaaaagttttgggtaaatataggtataaattgttaaatggaaaaagtttttttttatttttagttagagggaggttggggattttagttttttagaagttggtttgtggatgtttagagaatttttttggagattaggttagggttattgagtttgtttagtagggtgttgttttggatgttgttttgttttttattttgttagtgttgtgtttgggttgtgaaggtgtgtgtggtgtttggtgattggtggtggtttggagttgtttggttgttattggttgtttggttttttttgtttttgggtttgggttgtaggtttgttgtggtggattgggtggtggaagtttgatggtgttgggtgagtggttgttgagtggtgttgtgggagttttgtaggttttttgtgtttgtagtggagttggaggttagttgaatttggttgtgggattttggataggaggaggaggggatttataggatgtgttaatatggatttggaaaataaagtgaagaaggtaggggggtgtttgtggtgggtggtggttgttttatttgtgtgggttgtgtggtgtgtggtggttggaggtgttgaggtgggtggggtttgtgggttttttggtgtgagtttggttttgggtttgtggtgttttgggtttagggatttggttttttgggtagaggaggtgtttggtggttttgttagttttttatatttgggagtgatagaattggaagtgtgagtgagggtgggtgtgggatttttttttttagttttatggaattttagtggttgtaggtgttggaaattttatttaagatgttttagttttgtttgtgtttttttaaaaggaaaggatgagtttagggtgagtgtgggtgagattgtgatattttttggtttaggaagttgaattttattaagtttttgtggtttggggttttgttgtgttttgatagttttgatttttttttttttggttgggttgtttggggtgttttaaaatgagtgttgatttaatgtattgtttttgtatttgtgttggtgataatttttaatgtgattttttttttggttatttattatttgtttattgattgaggtagtgttttttttttagggaattatttgttaaagagtgtattttttttgtttggtaggtagttttaaagggtggttgttattagtgttttagtgtagggagatatttttagtttggttgttgttttgtaggtattggaattgatggttttatttgagttatttttgggttatgtggagtttggtgttgtttgggagaaaagggtggggattagattatgatttagaaggaatgttgatgttatatttgagtgaattgttttgtgtgaaagttttttttgttttaggggatttgtttatgttttattttgtggtaaatttaagttagttgttttttattaaatagagaagttttgtagagagaggaagggaaaaatatagaaaatagtttttgttttttttatatttatggtttt

SEQ ID NO: 682 - DNA, 3155 bp, Artificial Sequence
  chemically treated genomic DNA (Homo sapiens)
ggaattatgagtatgagaaaaataaaaattgttttttgtatttttttttttttttttttgtaaaatttttttatttgataagggatagttagtttaaatttattataaagtaaaatatgagtaaattttttggaatgaggagaatttttgtatagggtaatttatttgaatgtgatattagtattttttttgagttatagtttggtttttattttttttttttaggtgatattaggttttgtataatttgggagtggtttaggtagggttgttggttttagtgtttgtgaggtagtagttaagttgaaaatgtttttttgtgttgagatgttggtgataattgttttttgggattatttgttaaataaggagaatgtgttttttgatagataattttttaagagggaggtattgttttggttggtagataagtaatgaatgattgaaaaaaaaattatattagaagttattattagtatgggtgtgaaggtagtgtattaaattaatatttattttagagtgttttagatagtttagttggaagggaggagattagagttgttaaagtatagtagagttttaaattataaaggtttaatgaaatttaattttttgagttaggaagtgttatggttttgtttgtatttgttttaagtttgttttttttttttgaggaggtataggtagagttgaaatattttaagtaaagtttttaatatttataattattgggattttgtgagattggagagaagagttttgtgtttgtttttgtttgtgtttttaattttgttgtttttgagtgtggggagttggtggggttgttgagtattttttttatttagggggttaggtttttgggtttggggtattgtagatttagagttgggtttatattggggggtttgtgagttttatttattttggtatttttggttgttgtgtgttgtgtgatttgtgtaggtgaagtagttgttgtttgttatgagtgtttttttattttttttattttgttttttaggtttatgttaatgtgttttatgggtttttttttttttttatttgggattttatggttgggtttagttggtttttggttttgttgtgaatatgggaaatttgtggaatttttgtggtgttgtttaatagttatttgtttggtgttgttgaatttttgttgtttagtttgttgtagtgggtttgtggtttggatttgggaataaagggggttgggtagttaatggtagttgggtagttttgggttgttgttaattattgagtgttgtatgtatttttgtggtttgagtgtggtgttggtaaggtgagaggtggggtggtgtttgaggtggtgttttgttgggtaagtttagtgattttgatttggtttttgaagggattttttgggtgtttatgggttggtttttaaagagttgggatttttagtttttttttagttgaagatggagaagaattttttttatttggtaatttgtatttgtgtttgtttaggattttttatttgggttaaggggaatagttattttaatattaattttttagtttatttttagggtaaagagagaaaaaaaagagagagagagagattgtagggattgttagggatttttgtgatggattttgggtattaaatttaatattgtgttgtggagatgttttttttttaattgtttttttttataattttaaatattgttaagaaattgtattttatatttttaaagttagtgaagatttttagattgttttttgagtattgggttgtttaaaagtaaagatgatgtgaattattttagaaataggttgtgttatttttttggaagtagagggttgttttttgtttttgtgtgagatggtgttaggtttattgtgtgtttaggttttgatgaagtagagttattatattggtgtattaaagttgaatttattttatgttttaatttaggagtaattgtatttaatattattagattggttggtttggaagggagtttaatgattatttagtttagtttttttattttgtagggaattgaggattttagaggtgtagggatttgtttaatgttttagtttgttggggatagaggtattgtttatgaatttaaataattttttaaagatgtttggggttggaagtatagtatgttgattaaggaaaaagagtagttaattttttttaatttgtggttatggtaaaaaataatattgtttagatagtaggtgatttaatttggtatttatttttaaaaataataaaataatataaaataaataaataaaaattttttaataatgtagatatttaggtttagatgtatgtttgttttgttttgagaaatttggtagttaaaaatatttaaaatttattttagttaatatttgtaattttgtttatttgattatttgttaatatagagtattgatttataatgtgtatgttttttttattttattaagaattaaaattgaaattattaaaatgagttatgtatttttttttttagttgatgtaaaatttttttgtgttatttttttaaattattttgaaaggtgtgggtttttgtaaagtttgtttgttgtaagtgtataggattatgaggtttagttatgataaggtaattttgttttttttagagagtttaatagatggaaaatgtttagtaaagtaatttaaataaggtattaaataaatgttgtaatataaattttggatttttatttgatgaggttgtagagatgatattaagaaaattatttggaaattttttttttttaattgttaatttttgttttttttttattttttttttttaatttttttagtattatattgtgtgtgtgtattattggtaaggatggaaatagaaatttagtgagttttatttggaattattattgtgttaattatataaaaataattatagattatgtataaattataaaaataaaattgaggtagataagtgttaagagagttaaattgtaagtttttgtttagttatttaggtgttaagttatagttattaaggaggtagaattggtatggtttgatgagtatatgtagttgatgatagtggaatgaatagaagatggtatatatttttattttgattatttttatggatagtttagaa

SEQ ID NO: 683 - DNA, 14491 bp, Artificial Sequence
  chemically treated genomic DNA (Homo sapiens)
tattgtttatttttaaatttgtggaaattttgtggttagtatttgaagtttgttttattgttaaggttttttgttataagagatttttattttttgataataattaagaggtggaaaaagggaagttattattaattttttattttataaagtatatgaatttataatatgttaatagtggttaaaatgttttatttttaaggttatgttatatttttagaaagatttatatataagttagggagagatagggttaggttttttttgtattttgattattgtagaatgtttatttttatattttgtaataattttaatagtatgtgtgtttggggatttagagaattttatagtttttatatagtatttttttttatttttttttttaatttgtttttattaatgtattgttaggaggatgaagggtaaggaggatatataatttttttttataaagggtggaagtttattttaagaatggaaataaatttgtagattagtttttagagagattaaatttttgaaaaagtttaaaatttggtagatgaagtttttagaatagatgttagttattttgagattagtgttagagtggttttagagtggttgaggtttattgtttatttttgtttagtttattgttaagaatggtttttgtatttttattttttatttttttgagatggagttttgttttgttgtttaggttggagtgtagtggggagattttagtttattgtaatttttgttttttgggtttaaatgatttttttgttttagtttttagagtagttgggattataggtgtaggtaattatgtttggataatttttgtattttgtagagatggggttttagtatgttggttaggttggttttaaatttttgagtttaagtgatttgttgttttagttttttaaagtgttgggattataggtatgatttattgtatttggtttgtatttttattataaaatgttatttatttatttatttatttatttatttatttatttatttatttttgagatagggttttatttggttatttaggttggagtgtagtgagtgattatggtttattgtaatttttatttttttggtttaagtagtttttttattttagtttttagagtagttgggttataggggtgtattataatgtttggttaatttttttaaaaattttttgtagagatgggggttttattatggttgtttaggttggtttttaatttttgggtttaagggatttttttattttttggttttttaaagtgttgggattataggtgtgagttatagagtttagttgatttttgtatgtttaaatggttgggaataaagttaaaagaataataatattttgtgatatatgaaaattatattaaatttaaatgttggtgtttataaataatgttttattaggatttagttgtttttatttttttagtatttatggttgtttttgagttatgatgtttgagtttgaatagttgttatagggattgtatggtttgtaaaatttaaaatatttagttttttatagaatagtttgttgttttttgttttaatatggtttatattttatttgggaagttttgtgtttttagaggggagtatatttggtatgaaggttggtttaaatttaatattttagggaagttttttttgtttttgggttttagtttttttaattataaaatggggttagttgtagtgatttttggggatttgtttggtagtgggttaaataaataaagggagttggattttttggagggtaggattaggggttgagtaggagttggtgggtttgggtagggtgggttttttggggtttttaattttgtgggtgggtgtagtgttttgtaggttttgtttttattggggaattttgggtggggtgtgggtggtggggtgggggtgggttggggtggggttggtaggttgtttataagatgggtggtgtgtttgtttggggttatttgttgtagtttgtgtgttttttttagtttgtggtgttatggtttttgtttgtttgtttgtgttgttgttgttttttgtaggtggagttgttgagttggtgggtgtttggaggtttttgggttgggggtgaagtgggggtgtaggttggtgttttttttgtttgttggagtgtgggatgggggggggtagattgggggtatgttatttttaattggatattgaggtttgggaaattttgttggaaattttgttttggggttatgggttagtttttgggatggttttatgtgttgtgtgttttttgtttgttgttttttttgtttttttgggttttagttttgttgtgggttatgggtttgttagtgattaagttggtgttaattttttaatttttatatttttgttttttttttggtgattttggggtaggtttggagtgttgaattttttttttgtttttggggtgtttagagtagatagttttaggatttgagatggttttgggggttggggggttgtgtgtatttggaagggggagggttttagggttgtgtgaggtttttttttatatattaaggagaattgagttttaattttagttttggttttagttttgttattgatttgtgatttagggtaaagttttgtttttttgaatttttttttaatattgtattaagggtttgagggaatggggtaagaggggatattgtgttagggtttttagaaagttggggattttgttttttttgaggatagaggagaggaatggtttagatttaatatttagttaggagttgagtttttgttttttgtaagaagtgtgtttatttttttttaattgtagataagaaaattgaagtatttattttgagtgaggtgaagggggtaggggggagagaaggttttaattagtttagggaaattttttttttttattgtttattggtttttgttatagttgtttttgggttagtagaagttttatttatgtttgtagttggtttaggaggaggggggtaattttatttgggaagttggggggtatgggaattattggtgaaggtaatttgttttttatagtttgagttttgtgttttttttgtgttttttagttttagtttttagagtgagtgagtttttgtagtttaattattaatgttaatttttttgaaagttttggggtttttgtttttttgaatttatttagtggaaggttgattttgtttgtaggttttttttgaggaatgaatgagattttaggtaatatttttagtataattttaggtatgttatgatgattgtaaatgtggagtgtttttgttggggggttagatattgttttaataattttttaatgggtatatttaggagtttaattttaataataattttattgtgtattgtttttaaattggttttgaggttagagaggttaagtaatttgtttagggttatatagttaatatataataaatgggtgagttagattgaaatttaggtagttaggtttttaagtttttgttttagtttaatttttattttttgtgttattttaggtgttttattgttggtaattaaagatgggtttagaataggttgagattttaggttggaaggtaaaggaattttgaggtggaaggaaataaggttagagtgaggtgatgatttaatttaaattaaaggttattttgtttaaaatgttagtggttgaggatttaagttttttgtttttagtatagtgttttaaattaggttttgaaggatgtgttgggttaagtaattggggaagtatttgaagggatattatttaggtagtatagggaaaaagaggaaaggatttaggaggttgttgaggttattgtgtgtttagttatatgttagtttttttttaggggttgttgagtttttaggtgttttagggtgttgagtagttagttgtgttttgggggtattttgaaggatgtagtttgggggaaggggattgtgttagttttgtttgggtgatttattagttgtaggagatattagttttgggtagttgttttttgagataggtgttaagttttattttgattttagtttttttttttttggttaatgttatagattttttgtttgtaattggggtatagggttttttttttggtttgtttttttttttttttttagattgtggttggaaaaattagatatagttatggttggtttggattgaagagatgatttagtgtgtttttttttttttgtaggtagagaaaagtgaggtttagggagaaggattttgttaatagtagttaggagtgatagagtattttttatatgatagatttggtgtattttgtttttataaaaagatttgttatatggggattttattatgtttattttttaaatgtgagaggtaaaatggtattattttgggttagtagagggtatttaggattttaggatttttgattagtagtttttttattgtgggtggtgtttttttgattgttttattattttttttattatttttatattttggaagggaatttaggtttagtatttagttgtttttttttttgtttggttgggtttgttatattaaattagttttttttgtttagttgggagtattttttgatttgtttttttgttatttttttttaggttaattaaaggtagttttgttttgggagttttttttatttaaaggtgtttttatttaggggtatagtttattgatttggttttgggtttaggtggttgtggggaagtgttttttatttattatttattaagtgtattttagtttaaggatatttttggttttttatagtgttttttttttgattatatgggagtaggggtgggggtggaagtttaggggtttttaggatttttgagtgaatagtgagagtttttgggattttttgagtttagggagttattaaatatttatgaaaatatttgggttatgatttggagggttttatgaggttggggggaggtttttttttttgttgggttgatattttttattttaaaatgaaaggtttgaatagggtagtttttagagttttttttattttttaatttgattaataatttaagtatttattatttaaaagaggttttttttttgaaggaattaatttgagggaattaatatattttattaaatgttgaatttttttttttttttttttgtatattgagggtaggaattttgttttatttgtttttgtgaaatatttgttttttagtttgtatttaggaaatgtttgtatgaatgaataaatttgtgtatgtaattttattttaaatggtttattattgttatttattgttagtatgagtattttttagtattgtgaggtattattttttttatttttataggaaattgatgtttggaataatgtagtggttttttaaggttagaattaggtttttttgatagggtaaggtgtttggtttgagtgtttttagaatattttagatgaggaaatttgttgggtttgaaggtagatattttaggttttatttttgtgttgttgggtgattttgagtaaatatgttttgtttttgggttttagtgtttttaattttaaaataaggaggttggattattgttttttaagggttttttttgtttagagagtttattgatgaggggaggggttttttgttggtttttttggtgaagagtttaaataaattttagttttagaagagaagttggggtggtggggggatatttagtttttgttatttttagtttttagaaatagagggtttttttaaggatttggagtgttgagtttgtttgaatgaggagttggggaagttaggttgggtttttagttttatttttttgttgggagaagttggtttttagttgttttttaattttttggattggataggtgagtgtgatttttaaatgaatgtttaaaattggggtaaggggttggattgagtgttgtgagttattgtatgttagtgtagtttgtttgagttatttatttttttttaaatttttggttaataggatagttttgtggtgggggtgttggaatgagtttagagttttattttgttttttgggagttattgttttagtgtttggggtttgaggggatatataggatatgtttgtattaggttttgtatttttatagttttttgtttgtatgtagattttgatattgtatattgtgtagttagtttttaaaattgggttttagatttttgtagagtaggtagtattttttttttttttaaggtaaaattgaggttgtaattggtttgtatttttttagagagtaaaagttggtattgtttaggtttggtgtgattttaggattttttgatgtttgtgaggatttttttttgttttttggggttggttagagggtattgaaatattggtttggtgttatatagatttaattttagatgtgtgaagtttattttttattggttatatgaatttagttatgttattttatttttgagttttagttttttggtttgttaagaagattatgatattggtgtggtgaagtttaaaggagatgatagggttgtaaataaaggtatttagtattatgtttggtagggaggaggtgttatttagtgatagtttttttttttgtttaggttatttttatgttagggggttttatttttgaagattttgagtttaggttttttggaaagttttttttattttttttattttttttatttatttttatagttgggaggtgggaagggagaaatttagggtggggtttttggagtttaaattttttatttgtttattttagaagtgggttgtttgttaattattgaatgggtttatgtttaaataagaattagttttgggtagttttattttttttgttgggatttgttggagttttatgttgaatagtttgtagtttggagggagagggggtagggggtttgttaagggtattagattattttggatattgtttaggatttggggttatttttttgtgttggaggggtagagtttttatttttaaggaggttgagtgattgtaaatagtattttgaggggtggggtgttggtggatagaaaaggtatagtgttttgaaaagttagttttttgtatgtttttattgtatggtgttttagagagggaggagagagaatatatatgttaatagttggggttttatttaattttagaagaataagtttgattttttgggtttgtttgttattaattaatatagtggtgattttgggtatatttttgtattttattggggtttttttggttttatttgttgaaggttgggtgattgaaaaagagggtatagaaaattttagtttttgttttagttttgttgtttatttagggatatatatagttaatatgttattttgttgatgtgaattttagtgttttttataaaatatttgtggtatttaaaggttattattgttgtttggtaaatttgtaaagttttggttttattagtatttagatgagggtttttaatttggttagagtttggttttggggaggtggtgtttgtgtatatgttgaaaatgtaaattaagagttatagttattggggtttagatttttttattttttttagggggttgtagtattttttaaaaggttattttgattttagtagttttttttggttttgatttttttatagttatttttttttttttttttattttttagttttgtttttgttttttgttttttttaatttttatttttagtttagatttttttatttagtggtttttatttttttaggttgtattttatttttttttttgttttttaggtttgggagtttggttgttttagttttttttggtatagtagaagaggttgttggttaggtgatatttggggtaatggaaaggggaggtagggagaggttggtatgtgtggaaatagtgatttggtgaagtttagtagttagtggttaggtttgtggggattggtggtgttattttagtttttgggtgtgggggtagatgtggtatatggttggtttggttatttagagtggggatattttttgttttggagaagttttgttggagttgtttgtgggatagattgatttggtttggaggatggtttttttgggggttggtgagggaggttgggaagaggtaggaagttagtatttagggttgatttaattagttgagataaggttgtagtgtgggttttttattttgttttgagaatataggaggtttgtttatattttgagagtttttttagtttttggatttagtagggattttggatttgttgtttagattataagttttaattttaatgtatttttgtttttgaggttttgagggagttagtttttttttggttgtttttattggtaattggagtaatgtttagtttggttattgggttgggatagagggaggtttgtttttttgagatttgttttttatagattggaaaattgaggtttagagaagggaattgtttatgattatttagggagttagtaataagggtgttgggttagtttttggtagggagatatttagaggtttttgaattttttttttatttttagttggtattttaggattttggagtttttgttgtgggaatgggttgttttgaggtttggtgaaaagttggttgtaggtagtgttaggtttggtttttttttgagtgattgtgtttagagtaatttgattttgaaggtgatatttgaatttttattttatttttatttttagatttggtttaattatttaggtattagagtattagattatggattggtgtgtagtttttttttattttttagatttttatttatttattttgtttttggggatttaggtttttaagtagaattttaggtgtttttggttattgttatttgtatttttggggaaaataaaaatggtttttatttttgtttgtttaggataggtggttaaagttgtgtgattttgggtaggtttttgattatttttgtattttttttttatagtttgaagggatttgattggttgttgaaaagtttttgggtttagaagtaaaatgataatttattatagattatatttttttatagtttgtaaagtattatttttttgtttttaggttagtttttttttagtaatagaattgtttttgtaagtttttttaggtttttgattttttgagtattgattttattggttaggaggaaggtaggtaggggttaattatagttattatttattgattatgtgttgggttttttgtatatataaatgtattttttttaatttttattattttgtaaggtgttattagttttagttataaaagaggaaattgaggattttagagatgaaataaatttttaagtttatatagttaggaagtggtagaatttatatttgtgaatttgttttgatgtataattattttgggtggtagagttatagttgtgggttttaggttttagttattttggggaatgtttggtttttaagaagtgggtggggtggggaagaatagttatgagtagtgtatgttgttgggggttttttgttagaaattattttggtgggtttaggtgttggagttttaggtatttattattttttttttttattaaatttggtttgtttagttattatttttttggttttgttttttgaaagaagggttaagtgtgtttttgattttattttttttggggaggagttaggttgggagaggtttttattagtttatagttatttaagttttgattttgaatttttttttggtgttttagttaagtttttgtttttttgtttaagtgatattatttttatttttgtttatttttaggtagggatagggttgttttggagttttggtttagttagtgtgttgtggattggtgggttaggttggagagaagtgaagagtgggtggtagtgagaagtttagttgtggttgggatgtgtttttgaggaagatttggatttgaattttagttttagttttttagttgtatgatgttggataagtgatttagttgaattttagtttttttatttgtaaaatgggtagagtattttgtaaggttgttttgttatttaaatgaatttgtataaataaagtatttagtatggtgtttggtatgtagtggatattttttttagttatttatgttttttttggggtgatagaagttataggatttggggatagggttgggataggatttttttgtagttttatgtttatagttaaaagattagatggggagtataattgtaatgatagttgttgtttgtggatttgttgagatttttaggggtagttaatattttggaaggggagagaagataattttagtttgggagttaggatatttaggttttaagtttatttttgttgttagttgtttggatgattttggtaaaattttttgttttgtttgtttgttaggttataaaattagatattttttgttggtaggtgttagtttttgtagaataaaagagtatttttttttttttttttttttttaatagtttggggaagaatgtagtatttttaaatttttaggtattaattttagatttttattagttatagggttagtagagtttgtgggatttaggtttattgttttattttttattttttggagatagggtttttttttgttatttaggttggagtgtagtggtatgattgtagtttattgtaattttgattttttgggtttaagtgatttttttattttagttttttgagtagttgggattataggtgtgtataattatatttggttaatttttgtagagatggggttttattatgttgtttaggttgattttaaatttttgggtttaagtgagttttttattttggttttttaaaatgttgggattaagttattgtgtttagttattattgttttatttagttggtaatttttgttgtgtgtttatgaaagggataaagatataaggagatttgagagtttagagagggtgtttgtgtatgtatatatatgaatatatatgtttgggtaaaggtggggtgagttgaggagaatagattatatttttagttaggagtagggtggggtttatttttggttagggttgggtttggttgttgggtggtttggttttttaaagttattttagatttaatgggttttatttgaaaagagggtggaggagaggaggattgttggtgtttttttaatttttatataaaaaagagtgattgtttataattttatggggtttggttttgttttgttggtttagttttaaatggtttttatttattttggagttgtttttttttttgttagaggttatgggtggagaagggattaaaatagggtagagagggggtttttagagtttaaggagagatttaattttttgtgtttttttattattattgggagttggaagaagtttttttttagttttttgatttgttgtaggagggaaattttgggtttatttaaatgtagtttttgaagattttatttttttagagttttgaaataggattgaatttaggttgtgttgtggagttttggggtgattttagattagattagttttttttttggaaattgagtataaaaatgaagggttaaggatgaataggtgtttataaagagggttgaattgggaataaattttggttttagttttggttttgttgttgatttggttgtaagatttttatgttttatttttgtttatagtttttatttttttaatgtaaaatggaggtaatttttaatagttagtgggtatgttaattttatgggttgttttgaaatattttttagtatttttatatattgaaagagaggttggatgtataaataattttttatggtttttgggggtagtgaggggtgggaaaaggttttttagtttgagataagttttttgatggaattatagtttttgttgaggattttgatttggttaatagttggttaaagtgtattatttttttttttttttggttagattgatttttttatttaatagggtttttttggagtttggggtaggttggtgattttgtgtatatatgtgtttatgtgtgtgtttatgtgtttgtggttaaatgtttaggttagtgaagtttgggttttggtttagtgtggttattttttgtttgtgtggttttggataagtgattttatttttttgagtttttgtttttatttttgtaaaaagggattattaaaaggatttagataggttgtgtgtttggttaaggtttgttatttgggtttttgggggatttgttataggagatggaggtaggagtatagggattttgtttttaggtataggtatttgggtagttatgaggagttttttttttgttttgttaaattaaagttataggtatgggttatgtgtgggggtttgaattttagtattagtagtttggtagtttttgatttttgagttatgaagttatttttgagtagtatttaatttttttggttttttatttttatgggtgttaagtgtttagtattttttttattttttgggagagagtgatttttggttattgttttttttgtggtttgattttgtttttttttgggaatttagtattttttttttgtgggggtggaagagggtgtatgagggttaggttttatttgtttttttttagaagtttagtggggagagtataggagtggttttgaagtagtttttttgggttttttttgtaatgataataattttattttagggatagatgtttttttttagatatttttttttgttaatggtagttttagttgagtgaaggattgtttggggtgtttgaaatagagatttgatttttttttattttgagttatgtagtgaatgttttgtgtgattttgggtaagtttttgttttgttttgggtttagatttaagttgtgtgaaatgggaggataggagttttttgggttttggtattttgtgattttaagtagatttttagtttttgtagttatggtgtttggagaagatgggaatgttttttagtgggaggggtatggtgtattgaatttaatgaaaaattttaatttttttggtaaatattaggtattttagtgtttgaattaattagtagaataatgaattttgtttagagttgttgttttttgggtaaatagaagtttgagtttagaagttggaggaagggtgatgggtatttaaatgttttttgtgtttttgagggtatattgtttttatttggtggagttataggatgggagtagggtaattgatgtattgtagggttgtttgggatttttgatatttttttttggtaagtggtttggtgggagtggatttgagattttgttttgattagttgtgtttttatagggtagtggttgagtgatgattatgggtattggagtggatggtttgtgagggtagggattgtgttttttggtgtttgtatggtgttggtagtagagtagatttgtgggagatgtttggaaggtaagattgaatttaggagtatatttttgagttattaggtttgggtagtgttttgatttgaggttgttttagggtgtgtgtgaggtagttttgtttgttttggtttagattgatttagttgggaaaagtattttggattgggtaagattagaattaggagtttattttttgttttgtgtgaattagttgttattgtattatagagttttggagtgtagtattttagggttttgtgtatggagatttttggttttgaagttaggtagttttgtgtatgtaatttttgtttttttatttgttagttgtgttattaaaagaaaatgatttttttggttgtaaaaagaagtgaataatatgtttttagagttattaaaatagggtttagtatatagtaagtgtttggtaaaggatatttagttatattaataatttgattattattttatttattgtttttattttttttgagatgggggttttattttgtagtttaggttagagtgtaatggtgtgattttggtttattgtaatttttgttttttgggtttaagtaatttttttgttttagttttttgagtagttgggattataggtgtaagttattatgtttagttgatttttgtatttttagtagagatggggttttattatgttggttaggttggttttgaatttttgattttaagtgatttgtttgtttttgttttttaaagtgttgggattataggtgtgagttattgtgtttagttttatgtattatttttatttgtttagaatggaaagagatttgtttaaggatatgtggtgagttagaggtagagtgggatttaggatgtaggtttttaggttttggtttggtttttttttagtttttgaatgtttattttattagtttttgggtattagttgttatggagtattggggatgttggttgatgtgttttttttttttattttaga

SEQ ID NO: 684 - DNA, 14491 bp, Artificial Sequence
  chemically treated genomic DNA (Homo sapiens)
tttaagataaagaaaggagatatattagttaatatttttagtgttttatgatagttgatgtttaaaagttagtgaagtgggtatttagaaattagaaagagattaggttagggtttggagatttgtgttttggattttattttatttttaatttattgtgtgtttttaggtaagtttttttttattttgggtaaataaaaatagtatatgaggttgggtatagtggtttatatttgtaattttaatattttgggaggtggaggtaggtagattatttgaggttaggagtttaagattagtttggttaatatggtgaaattttgtttttattaaaaatataaaaattagttgggtgtggtggtttatgtttgtagttttagttatttgggaggttgagataggagaattgtttgaatttgggaggtggaggttgtaataagttaggattatgttgttgtattttagtttgagttatagagtgggatttttgttttaaaaaaaataaaaatagtaaatgaggtaataattaaattattaatatggttagatattttttattgagtatttgttatgtgttgggttttgttttaataattttggaggtatgttatttatttttttttatagttgagggagttatttttttttggtgatatagttggtagatggaagagtgaggattgtatatgtagggttgtttgattttagagttaggagtttttatgtatagggttttgggatgttatattttagggttttgtgatgtagtggtagttgatttatataggatagggagtgggtttttggttttggttttgtttagtttaggatattttttttagttgagttagtttgggttgggatagatagggttgttttatgtatattttaagatagttttaggttagggtgttgtttagatttgatgatttaggagtgtatttttggatttagttttgttttttaaatattttttatagatttattttgttgttagtattatgtagatattgagaggtataatttttatttttatagattatttattttagtatttataattattatttagttattattttgtggagatatagttgattaggatagagttttaggtttatttttattaaattgtttgttaaaagaaagtgttaaaggttttgggtagttttatagtatattagttattttgtttttattttgtagttttattgagtgggaataatgtatttttaagagtataggaaatatttggatgtttattattttttttttagtttttgggtttaggtttttgtttgtttagagaatagtagttttgagtaaagtttattattttattaattaatttaaatattaaagtgtttagtatttgttaggagagttggggttttttattaagtttaatatattatgttttttttgttgaaagatatttttattttttttagatgttataattgtaggagttgggggtttgtttagaattatagaatgttaggatttaaggagtttttgtttttttgttttatataatttgaatttgagtttggaatagggtagggatttgtttaaggttatatagagtgtttgttatataatttaggatagaaagaggttaggtttttgttttggatattttaggtagttttttatttagttgagattgttattgataaaggagggtgtttgagaaggaatatttgtttttaagataaggttattattattgtaggagaggtttaggaaagttgttttagagttatttttgtattttttttattgggtttttggggagaggtaggtggaatttgatttttatgtatttttttttatttttatagagggagaatgttggatttttggaagggagtggggttaggttataaggaaggtagtggttaggaattatttttttttggggagtggggagaatgttgaatgtttggtatttgtgggggtggaaagttagagaggttaagtgttgtttagagatgattttatgatttgggaattaggagttgttgggttgttggtgttggaatttaagtttttgtatatagtttgtgtttgtggttttggtttggtagagtaggaggaaggttttttatggttgtttaagtgtttatatttaagggtagggtttttgtgtttttatttttattttttgtggtaaattttttaagaatttaagtgataggttttaattaagtatatagtttgtttaggtttttttaatagtttttttttgtagagatggaaataagggtttagaaaagtaaagttatttgtttaaggttatataagtaggaagtagttatattgggttagaatttaggttttattgatttggatatttaattataaatatataaatatatgtatgaatatatatgtatatggggttattagtttgttttaggttttaagggagttttgttaagtaggggggttaatttagttgggagaaagaaagaatggtatattttggttagttgttgattaggttaaagtttttaataggggttgtagttttattaggagatttgttttaggttgagagatttttttttattttttattgtttttaggagttatggaaggttgtttatgtatttagttttttttttagtatgtgaaagtgttaagaggtattttaaaataatttatgggattagtatgtttattggttgttaggaattatttttgttttatattagagaaatgaaggttatgagtgaaagtggggtgtgaagattttgtagttaagttagtagtaaaattaaggttgaaattaagatttatttttagtttagttttttttgtgggtatttgtttatttttaattttttatttttatatttagtttttaaaaaagaaattagtttagtttgaagttattttggggttttgtggtatggtttggatttgattttattttaaagttttgaaaagatggagtttttaaaggttgtatttagatgagtttaggattttttttttatagtaagttaaggggttgggaagaaattttttttagtttttagtggtgataggaggatatagggaattaaatttttttttgagttttggaagttttttttttgttttgttttggttttttttttatttatgatttttgataagagggaaggtaattttaaagtggataagagttatttaggattaggttagtaagatgggattaagttttgtgggattgtgggtaattatttttttttgtgtaaaggttgggaaggtattaatggttttttttttttttgttttttttttagataaagtttattgagtttggggtgattttgaagaattaggttatttagtagttaggtttagttttgattagagatggattttgttttgtttttggttaagaatgtggtttgttttttttagtttattttatttttgtttaggtatgtgtgtttgtgtgtatatatgtataggtattttttttgggtttttaagtttttttgtatttttgttttttttatgaatatataatagaaattattaattaagtaagatagtggtggttaggtatagtggtttaattttaatattttgggaggttaaggtgggaggtttatttgagtttaagagtttgagattagtttgggtaatatggtgaaattttatttttataaaaattagttaaatgtggttgtgtatgtttgtggttttagttatttgggaggttgaagtgggaggattatttgagtttaggaggttgaggttgtagtgagttatgattgtgttattgtattttagtttgggtgatagaggaagattttgtttttaaaaaataaaaaatagggtaatgggtttaggttttatagattttgttggttttgtggttggtggggatttgggattagtgtttgggggtttagagatattatatttttttttagattgttggggagaaagaagggaggggaagtgtttttttgttttatagaaattaatatttgttaatagaaggtatttgattttataatttagtaaatagataagataagggattttgttaaggttatttaagtagttggtagtggagatggatttagaatttaggtattttggtttttagattggaattattttttttttttttttagggtgttggttgtttttaagggttttagtaaatttataggtagtagttgttattatagttatattttttatttagttttttggttataggtatgaagttatgaaaaggttttattttaattttatttttaaattttatggtttttattattttaggaaaagtatgagtgattaaaaggagtatttattatatgttaagtattatgttgggtattttgtttatataagtttatttaaatggtaaaatagttttgtaaggtgttttatttattttgtagatgagaagattgaggtttagttgagttatttatttaatgttatgtaattagaaagttagagttgggatttaaatttagattttttttaagaatatgttttaattataattaggttttttattgttatttattttttatttttttttagtttaatttgttagtttataatatattggttgggttagggttttagggtaattttgtttttgtttaggagtaaataaaggtgaaagtgatattatttaaataaaggaatagaaatttggttggggtattagagaggagtttagggttagggtttggataattgtgaattaatgagagttttttttgatttggtttttttttaggggaggtagggttggggatatatttgattttttttttaggaggtaagattagaagggtaataattgggtaagttaaatttagtggggagaggggatggtgagtatttggggttttaatatttggatttattagaatgatttttagtaggagatttttagtagtgtatattatttgtaattgtttttttttattttatttattttttaagggttagatattttttagaatggttaaaatttggggtttataattgtgattttattatttagagtggttgtgtattaaggtagatttataagtgtgagttttgttattttttaattatatgagtttgggagtttattttatttttgaaatttttagtttttttttttgtgattagggttggtagtattttgtagggtgatgaggattaagaggaatgtatttgtgtgtgtaagggatttagtatgtgattaatgaatagtggttgtgattaatttttatttgttttttttttggttagtgggattagtgtttaaaggattagaggtttgggaaaatttgtagaggtagttttgttgttggaaggaagttagtttggggatagggagatggtgttttgtaaattgtaaaggaatataatttataataggttattattttgtttttgagtttagagattttttaataattaattaggtttttttagattgtgaaaaaaagatatagagatagttagagatttgtttaaggttatatagttttgattatttgttttaagtagatagaggtaaagattatttttattttttttgaaggtgtaaatgatagtgattagaaatatttgaaattttatttggggatttgggtttttagggataaaataaataaataaaaatttagaaggtaaaaagaaattatatattaatttatggtttggtgttttggtgtttgaatggttaaattaggtttgggggtgggggtggagtgagggtttaaatgttgtttttaaggttgggttattttgaatataattatttaggagagagttaggtttggtattgtttgtaattagttttttattaagttttagggtagtttatttttatagtaagaattttaggattttagggtgttagttagaaatgggggaagggtttaggagtttttggatgtttttttgttaggagttgatttagtatttttgttattaattttttggatgattgtggataatttttttttttgagttttagttttttaatttgtaaaagataggttttaaagagataagtttttttttgttttagtttagtaattaagttgggtattgttttgattattggtggagatagttaggagggggttggtttttttagggttttagagatagaggtgtattgaagttggagtttgtaatttaggtagtagatttgaaatttttgttggatttgagggttagggaggtttttgggatgtaaataaattttttgtgtttttagagtagagtagagagtttatgttgtagttttattttagttgattagattagttttgggtgttggttttttgtttttttttagttttttttattgatttttaaggaagttattttttagattaggttagtttgttttatagatggttttggtagggtttttttaaggtaaggagtatttttattttgggtagttgggttagttatgtgttatatttgtttttatgtttagaggttagagtgatattgttagtttttgtaggtttggttattgattgttgggttttattaagttattgtttttatatatattagtttttttttgttttttttttttattattttaggtgttatttgattagtagttttttttattgtgttagagaaaattggagtagttgagtttttgggtttggaggatagggggaggggtgagatgtagtttgaaggggtgggggttgttgaataggaaggtttgggttgaaggtgggggttgggggaagtaggaggtaagaataaggttgggaagtgggggagggaggaaggatggttgtagaaaggttaaagttagaaagaattgttgagattagagtgattttttggggagtattgtagttttttgaaaaggataaaaaggtttaaattttaataattgtaatttttagtttatatttttaatatatgtatagatattatttttttaaagttaaattttggttgggttaagaatttttgtttaggtgttaataaagttagaattttataagtttgttaaatagtgatgatgatttttgagtgttataggtgttttatagaggatattggagtttatattaataaagtgatgtattaattgtgtgtgtttttgggtgagtagtagagttaggatgggggttggagttttttgtatttttttttttagttatttagtttttagtagatgggattagagaggttttagtgagatgtaagaatgtgtttaaggttattattgtgttagttaatgataaataagtttaagaagttaggtttatttttttaaggttaaatgagattttaattgttgatatatgtgtttttttttttttttttttagggtattatgtagtgaaaatatatgagaaattggttttttagaatattgtattttttttgtttattaatattttattttttaaagtgttatttgtaattatttagtttttttaagggtagaaattttgtttttttagtataggagggtgattttaggttttggatagtgtttagagtggtttgatatttttggtaaattttttgttttttttttttttaggttgtaaattgtttagtatgaggttttagtaaattttagtaggagaggtggggttgtttagaattggtttttgtttaaatataaatttatttgataattagtaaatagtttatttttaagataaataaataggagatttggattttaaaagttttattttagatttttttttttttattttttagttgtgggggtagataagggggataagggggatggagaaagttttttaggagatttgggtttagaatttttagagataggattttttggtatgaaggtggtttgggtaaggaagggaattgttattaagtaatattttttttttattaggtatggtattaggtgtttttatttatagttttgttgttttttttaagttttgttatattggtattatgatttttttaatagattaggaggttggggtttagaggtggagtagtatgattgaatttatgtagttagtaagaggtggattttgtatgtttggagttaagtttgtgtaatattaagttaatgttttaatgttttttggttagttttaggaagtaaagaggagtttttataaatattagaaaattttggggttatattaaatttgaatagtattagtttttgttttttgaaaaaatgtaggttagttgtagttttagttttgttttaaagaggaaaaaagtattatttgttttgtagaggtttaaagtttaattttgaggattggttgtataatgtataatgttaaagtttatatgtaggtaaggggttgtgaaagtgtgggatttagtataaatatgttttgtatgtttttttgagttttggatattgaaatagtgatttttaaaggataaggtaaaattttgagtttattttaatatttttattatagagttgttttattagttaagagtttgaaaggaaatgggtgatttaggtaggttatgttagtatgtagtgatttatagtgtttggtttagttttttattttaattttaagtatttatttggaaattatatttgtttgtttagtttgggaggttgaaggatagttaggagttaattttttttaatagggagatggggttgggagtttagtttggtttttttagttttttatttaggtaggtttagtattttaagtttttggaaaagttttttgtttttaggagttggggatggtaggagttgaatgtttttttgttattttaattttttttttgagattgggatttgtttagattttttattaaggaggttagtaaagggtttttttttttattaatgggttttttgggtaggaaggatttttggaaggtaatggtttagtttttttattttagagttggggatattgagatttagagatagggtatgtttgtttaaggttatttagtaatgtagaagtaggatttaaggtatttatttttaaatttagtaaatttttttatttggaatattttgaggatatttaaattagatattttgttttattagaaggatttggttttgattttaggaagttattgtattgttttgagtattaattttttgtaaaaatagagaaaatggtattttgtagtattgggagatatttatattagtaataaataatagtaatgaattatttagaataaagttatatgtatgaatttatttatttatataagtattttttgagtataaattaggggataggtattttataaaaataaatagagtagagtttttgtttttagtgtgtggggggagagagggagggatttagtatttggtggagtatgttaatttttttaagttaatttttttaagagagagattttttttgaatagtaggtatttaagttattaattaaattgagagatggaaaggattttggaggttattttgtttaaattttttattttaaggtgggggatgttagtttagtggggaaagaggtttttttttaattttatggaattttttaaattatggtttaaatatttttgtgggtgtttgataattttttgggtttaagaagttttaagagtttttattgtttatttaagggttttagaagtttttaggtttttgtttttatttttatttttatgtaattaagaagaggatgttgtagaagattagaaatgtttttaagttaaagtatatttgataggtgataggtgggggatatttttttataattgtttgggtttggggttaagttagtaggttgtgtttttgggtaggaatatttttgggtggaggggatttttaaaataaggttgtttttaattggtttgagagggagtggtaggaaggtagattagggaatgtttttagttggataggaagaattggtttagtatagtaagtttagttaaatagaggagaggatagttgggtattgagtttgggtttttttttaaaatatgggggtggtaaggggaatgatggaatagttgggggaatattatttataatgggagggttattagttagagattttggggttttggatgttttttattaatttaaagtagtattattttattttttatatttgggaagtgggtataatagaatttttatgtgataggtttttttgtgaggataaaatgtattagatttgttatataaaaagtattttattatttttaattgttattagtaaagtttttttttttgggttttatttttttttatttgtaaaaagaaaaggatatgttggattatttttttagtttgagttaattgtgattatgtttgatttttttaattataatttagaaaagagggaggggataggttaaaggggaagttttgtgttttagttataggtaggaggtttgtgatattagttaggaaggggagagttgaggttaggatgagatttgatatttattttaggaagtagttgtttagggttgatgttttttgtagttgatgggttatttaggtaggattgatatagttttttttttttaaattatattttttagaatgtttttaggatatagttgattgtttagtattttgaagtatttgaaggtttagtagtttttgggaggaaattggtatgtgattgggtatatggtgattttagtaattttttgggtttttttttttttttttttgtattgtttaggtggtatttttttggatgtttttttagttgtttgatttgatatattttttagggtttagtttagagtattgtgttagaggtagaaggtttgggtttttagttattaatattttaggtaaggtagtttttggtttaggttaagttattattttattttggttttgtttttttttattttagaatttttttgttttttagtttaaaattttaatttattttaaatttgtttttagttattaatgatgggatatttggagtagtataaagagtagaagttaagttaaagtagaaatttgaaagtttggttgtttaaattttaatttgatttatttatttattgtgtattaattgtgtgattttgggtaagttatttaatttttttagttttaggattagtttaagaatagtatatagtaagattgttgttggaattaagtttttggatatatttattagaaagttattagagtaatgtttggttttttgataaaggtgttttatgtttgtaattattatggtatgtttggaattgtgttggaagtattgtttagggttttatttattttttaagaagagtttgtaggtagaattaattttttgttaagtaaatttagaggaataggagttttaaggtttttaaagaaattaatattaatggttaaattgtaaggatttatttgttttgaaaattggggttaaagggtataaagggggtataaagtttaggttgtgggggatagattgtttttattagtaatttttatgttttttaattttttagatgagattgtttttttttttttaagttggttgtgggtatggatagagtttttgttggtttagggatagttatgatggaggttagtggatagtgagaaggaaaggtttttttgggttgattgaggtttttttttttttttattttttttattttatttaaggtggatgttttaatttttttatttgtaattgagaaaaaatgaatatattttttgtagaaagtagaggtttagtttttggttaagtgttgagtttaaattattttttttttttgtttttgaaaagagtagagtttttaattttttagaaattttaatgtagtgtttttttttgttttatttttttagatttttggtgtagtattgggaagagatttagaagggtaggattttgttttaagttataagttaatgatagagttggggttagaattgaggttagggtttagttttttttggtgtgtgaaagagggttttgtataattttaaaatttttttttttttgagtatatgtagttttttgatttttagggttattttggattttaaagttgtttgttttgggtgttttgagagtgaggaggggatttagtgttttaagtttgttttagggttattagggaagggatgagggtgtgggagttgaagagttgatattggtttagttattaatgagtttgtagtttgtggtggggttgaggtttggggaggtgggaagagtaataggtgaggggtgtatggtgtgtgaagttattttggaggttggtttgtgattttggagtaaagtttttaataaagttttttgggttttggtgtttggttgggggtagtgtatttttgatttgtttttttttattttatgttttgatgaataaaggaggtattggtttgtgtttttgttttgtttttagtttgggaatttttaagtatttattgatttggtgattttgtttatgaagaatagtagtagtgtgaatagatgggtgggggttatggtattgtggattggagaaggtgtgtaggttgtggtgagtggttttgggtgggtgtgttatttattttataggtggtttattggttttgttttggtttgtttttgttttgttgtttgtattttgtttggaattttttagtggaagtgaggtttgtggggtattgtgtttgtttgtggagttggaaattttaagggatttgttttgtttgagtttgttggtttttatttaatttttagttttattttttgggaggtttaattttttttatttatttgatttattgttaggtaggtttttagagattattgtggttaattttattttatagttggggaaattaaggtttagggatgggaaggatttttttagggtgttgagtttagattagtttttatattgggtgtgtttttttttgaagatatagaattttttaaatgggatgtgaattgtgttaagataggggatagtaaattattttgtaaagggttaaatattttaggttttgtgggttatatgatttttgtggtaattatttaaatttgagtgttgtagtttaaaagtagttataaatattaaaggaatgagggtagttaggttttaataaaatattatttatagatattgatatttgaatttaatataatttttatgtgttatgaaatattattatttttttgattttatttttaattatttaaatatgtaaaaattggttgggttttatggtttatgtttgtaattttagtattttgggaggttgaggaataggaggattttttgagtttaggaattggagattagtttgggtaattataatgagatttttatttttataaaaagtttttaaagaaattaattaggtattgtggtgtatttttgtggtttagttattttggaggttgaggtgggaggattgtttgagttagagaggtgaaagttgtagtgagttatgattgtttattgtattttagtttgggtgattgagtgagattttgttttaaaaataaataaataaataaataaataaataaataaataaataaatgatattttataataaaaatgtaggttggatgtagtgagttatgtttgtaattttagtattttgggaggttgaggtggtggattatttgagtttaggagtttgagattagtttggttaatatgttgaaattttgtttttataaaatataaaaattatttaggtatggttgtttgtgtttgtaattttaattgttttggaggttgaggtaggagaattgtttgaatttgaggggtggaggttgtagtgaattgagatttttttattgtattttagtttgggtaatagagtaaaattttgttttaaaaaaataaaaaataaaaatgtaaaaattatttttagtagtgggttgaataaaaataggtggtgggttttagttattttgagattattttgatgttggttttagagtggttgatgtttgttttaagggttttatttattagattttgaatttttttaaaagtttgatttttttgagaattggtttgtaagtttatttttatttttagggtaagtttttattttttataagagaaagttgtgtgttttttttattttttatttttttaatagtgtattggtgggagtaggttgagggaagaagtggaggggggtgttatatggagattgtaaaattttttgggtttttaagtatatgtattgttggaattattgtagggtgtgaaggtgggtattttatgatgattgaagtataaaagaagtttaattttgtttttttttgatttatgtataaatttttttaagggtgtaatatagttttagaagtaggatattttggttattgttggtatattatgaatttatatattttgtggagtggagaattggtagtgatttttttttttttattttttaattattattaaagaataaaagttttttgtggtagagaattttggtagtaaagtaaattttaaatgttgattatggggtttttatagatttaaaggtaagtaatg

SEQ ID NO: 685 - DNA, 6343 bp, Artificial Sequence
  chemically treated genomic DNA (Homo sapiens)
gattgtttatttttgttattagttgaaggtaaggttgttttgttatgagtgttttttaatttttataaaatgaaaagaaaaaaagggaggattattagtttattatttagaggaatggggaggttgtaaaaattgttgatgggtagaggtgaagatgttttttttggattgtattttttggtgttttgtaattagagtttagttgtgggatttgttgaagaaatttgatttttttgttttggtgagattttaaaaattagaaatagaaatttttagagttagagaggaaatataattaaatagtatgtgggtatttttttttttatttttttttttttaaataatattgttttgagtttttattgggtaaagagagaaagtttgagtttttatggatgttatgtggaggttagaaatggtttaaaatgtagatttttaattagttttttttgtggttgaagaggttaattttttttataaaatgagtttatttgttgattgttagttattttaaagtgaagggatttagtatttaaaataaattgagtaagtttgtttgtttgtttttattgttaatttaaatgaatttaaaatatggagtaatttaagaaaatatataatatgttttagatagtttttaaaagtagggaaagtttagtatttatatagtgattagggttagttttaagtgttaagtttttttaaatgtatttattttatgtatatttttttgagttattatatatttttaaaattgtgagtattggtatattgatttaggaagagtaatataatttttagagggaattttatttttaattagggattaaagagatgtttttttaatagtgggtttgagttttgtttttaagtaggaattaatattggtgggaaaatttgaatttaggagtaatggttgtgttttggtattttttaaaaatatatattaataggatgtttttgagattgaaaaaatattgttttatatgtttggtagaagtttttatatttggttttttaggtgaattatatttatagtttttttatttagaggtaggatagagttaaaatattttgtttattattaaaatatatatttttgtttaagttaagaaattagaaaattagggtttagaagtaaggtatattttttgagtgagaatatgttttgtaattttatatattttttgttttgtaggagtaaatgtggatttgagggaaatttttttttttatttttatttttattttgtgtaatttaatattatttttgttaggaattttaattttgttattttaaaaaatgagatatttgtgatttagggtgaatttgttgaatgtaggtatagtagaggaaattttagattttatgagtgtttgagttttgtttagtgtaaattttttgtgaatattgggttagtgtgtggttgtgtttatttgtgtgttgatatttttagtatgtttggtttatttgttttgattttgggtgtggtgttttagttaagttgggtttagtgttttggttttttttagttgataagtttagtttgtttgtttttggttgtggtttttttatttttttttattagtttattttatttttttagatttttttttatttatttttttttatttttattgtgtttatttttatttttgttttttattggttttttatttttttttttttgtagtttttttttgttgtgatttttttttttaattttgtaggtttgaaagaaggttatatatgtatgtttatatttatattttatatgttttgttttaaataattttatgaatattgttttttgttttgttttttgggttattttttttgttgtttttttttagtttgttttgatttgttttttaaaagtatgtttttgtttttttgttgttttggtgttttttttttgatttattagggttgttgggttggtgtagattgttttttttttttttttattttatttttttttttggtttttttttttatagtgggagtttgtgtttttgttttttggttggtttttaagtgttttgttaggttttttttttttttgtttttttggttttggtttttgattttttggtttgttggtatttgttttttttttttgttttgttttttgttgtttttgtttgttttttttggtgtttgtttgggtgttgtgtttgtttttggattgttagttgtgtagtgggtttgttggtgtttgtgtgttattgtgtagtggagtttggtggaatttttgttgatgttatgttattttttatatggagtaggagtagagggaagagagagggatgagagggagggagaggagagagagtgtgagattgagtgagaaagttggagaggagtagaaagaaattgttagtggtggttagattttggaggttttagtgtatttgtggatttttttggaatttggtatttttaggagttttgtagtttttttaggtttggtttttgggtgtttgttgtgtagttggaggtttggtttgttggaaattgttttgggaagtagtgggatgtggagatagtagtttttttttggtagttggtaagtggaggttatttattttgtagggatgtgagataatgtgagtttggaaatttgttttattttggagaatttttattgtaggtgatttgtggtttttggggttaagttttgtttaaggtaatgtagttggtaaatagattttgtaaagttttgttttttttgttttttgttatagatattaataatttatagggtgttgaagttgagagggaagttagattgtggttggtatttaaaatgaggtatttttttttaaattttggtgttaatattgtaggaataaatttttgggttaaggattagtatttttaagataaagggttgggtataaagttttagttattggaagattagttttttttttattgttatttattgggaaaaaaaagaaaagaaaaagattttattttaattggtagttagtgattttttaggtttaagtgaattatttgggagttaggtttggatgttaagtttttattatttttttggattgtaatttttttaaattgattattagttaattttaatttggtattttaggagatatattttaaatggatgtagagaattattttttagttggagattaagaaaaaaatttttgattttaaatttttgaaatatgttttttttttttagtttaattattttatttttttaagtaatttagaaattaaattattataaggtggtgtgatttttttttatttttttgtgtgagtattgttttattaaattaaatggaaaaaatttttattattataaatgtaaatattagaatttatatattttaaaatatttttatgaaaaattaatttgatttaaagaaatttttttgtatttgttttagtttattaattaaaattaaagatgtttttattatataaaatattattttggtagaaatttatttaaaatttaaatattaataatattaagaaaataaagtatataagtaaaataaattgaagatttttgttgatgtaatatgagtatataatattttaataattaaattttttttaaaaaattaaatagttattttatttgtggaatgttttattttaatttagtaaaattatatttaaattatttaggtgttttgttttttaagttaagtgtgtttgtttttaaatgtttttaaagtatttatattaattggttgtaaagaatgtatatatatggtaaaatatagaattgaattgagtagtattttaatttttttaaataattatttattataaattaatttattggttaattttataatttagtttatttaaaatatatgtttttgtgttgtttatttttaaattttttattaaagattttgttatggggtaataaagtgtatgaaaaggggggaaatgtgaaaggatttgggattatttgaattgtattttttttgtatttttagttttgtggtagttattagaaattattttttagtaaattgttttattttttagggtttgtttgtttgttttgttatggttttttgttttttgttagttgtgtagtgttttttgtgtgtttataatataaaatttaagttggttaaaataagagtttttggtatatatattttaattagaatatgaattttgggggtgagaattattttttattaggaaaagttttttattttaatttgtgagattagttattgaagttagttttgaagtttggtagttaaattttttatagaagatttgttttgatagggtaagtttaaggattagtaggtgggaattggaggtttttttttaaaaaattattttttttagttatttagatttagtttttttagtaggtttggttattaaatgaagtataaaaatgtaagttttaaggtttattttgattgtaaaataaatttttaagttataaggatatgtaggagtgagttaaggaatatgttttgattttttttttagtttttagagtggagttttatgagtttttgaagatttgttttgtattgttttgtttggtttttagtattgaagtatggggaagtggggggaagaatgtgtaataattgattgattttatattaagtaatgtaattttttttttttgtatattttattttttaaaaaaaataaataaataaaaattatttgtagttattatttgtagtgttttggttattagttaataatgtagttagtttagatatataaaaaaaaaagattattgaaatgatgatgatatgtaaattttttttgaaattattataagtaaatatttgaagtttggattaataaaattttatttgtgttattttatattgagttagtagaaagttgtgataatgaattttgtaatattttatgaatagatattttaattagggattaattttgtgattttattgtagaattattaaatttggagttgttaaattgttatttttgggtttatgggtttataaggattgaattggtagagtttttgtttgtgtttttgttagtgggtgggggaattgtttggttgtttttattttggatttttatgttatagtgttgggtagttttttttgtaggtagtgattttggttagaggttttttagggtttagttttttttaggagaggttgagatgtagggaaatggtatttaggttagaggtaggtttgtagttttttgttttgtttttgtgtttttgttaatttgataatgtttgtttttattttgatttttgtatttgtgtgaagtgggttttttggttgttggtgtattttggttagtgtggagagaggtaggtgttgagattgaaggggtttagggagttttggattttttttttttgtttttaaagtaattgtggtttttttatttatttggtggagttttttgagatttattttttttggtttgtttgtggtagagaagggggagtgtgttaaatgtttggtttgttgtgttgtggttgaaaatgtgaaaaagatttggtttgtttgggagagaaagggggagaattgggtagtagttatattagagttatttttttgtttttggtgggtagtaaattttttaagaatgtttgttttgttttttttagttttgtttagtttatttagtgttttttttttgtgattttaaattatattttagggtaattatttgtagtaagtaaataaatggttgggttagtatttttaggagaaagtgtggttaaatatggaaaagtggtttttgatggatgagaggtttgaatttagtttgtttttgaaatattttaggttaagagtttgtttgttttagaattatagaaaattgagggaaattgttgtttaggataggggtatgttggtgttgatgttttataaatgtttattgagttttaattaatggataagtattgaagggtggtttttgtatatagttttttaaagagaaaagttttttttatttatttatttttgttgttattgtgtttagatgagtttttaattttggtattgagatttttgaaagtaggtttatagtttttttagtatattgtggttttatagttttttaatttttgggtatttttgtggtaattttggagggagatttttttttgataaataaatgttttgggtttgaggttaggttggagatgttgttgtatatgttagaggttgttaggttggaaaaatatgtttgaagtttagtatatagtaggtgtttaatagttagtgtaatgtagttttatttgagttttgtttatttgatggttgttgttttttatagtttttttttttttttgttttgtaga

SEQ ID NO: 686 - DNA, 6343 bp, Artificial Sequence
  chemically treated genomic DNA (Homo sapiens)
tttgtaaaatagaagagaaggaaggttgtaagaagtggtggttgttgagtgagtagggtttagatgagattatgttatattagttgttaggtgtttattgtgtgttaggttttaggtgtgtttttttgatttgatagtttttggtatgtgtagtagtatttttagtttagttttgggtttaggatatttatttattaagaggggatttttttttagagttgttgtaaaagtgtttagaggttagaggattataaagttatagtgtgttggggaggttgtggatttatttttaagaattttggtgttggggttaagaatttatttgaatgtaatggtagtgggagtgggtgggtggagaggatttttttttttgggaagttgtatgtaaagattattttttagtgtttgtttattagttggagtttggtaaatatttgtagaatattagtgttaatgtgtttttgttttagatagtagttttttttggttttttgtaattttgaaatgaatgggtttttggtttagggtgttttaggagtgagttgagtttgggttttttatttattaggagttatttttttatatttagttatatttttttttagagatattaatttggttatttatttatttattataaataattattttaaagtatgatttaagattgtagaggagagatattgggtggattgagtgagattgaggagagtagggtaaatgtttttggagggtttattgtttgttaaggatggagaaatagttttggtataattgttatttagtttttttttttttttttttgggtgagttaaattttttttatgtttttaattataatgtagtgagttaagtatttaatgtgtttttttttttttgttataggtaagttgggagaggtgggttttgaggggttttattgggtgggtagaagagttgtggttgttttaaagataagaaaagaaggtttagggttttttaggtttttttgattttagtgtttgtttttttttatgttaattagggtatgttgatgattggagggtttattttgtgtgggtgtggggattggggtgggagtaagtgttgttgggttggtggaggtatagaggtggggtagggagttgtgggtttgtttttggtttgagtattgtttttttgtgttttggttttttttgaagggagttgggttttggggagtttttggttaaggttgttgtttataggaggggttgtttggtgttgtggtgtggggatttagggtggggatggttaggtggtttttttatttgttagtgagaatgtgggtggggattttgttgatttgatttttgtgggtttgtgggtttagaagtagtagtttggtggttttagatttagtgattttgtagtaaaattataggattagtttttgattgagatgtttgtttgtgagatattataaaatttattattatagttttttattaatttgatatgaagtaatatagatgggattttattagtttagattttaaatgtttatttatgataattttggaggaaatttgtatgttattattattttgataattttttttttttatatgtttgaattggttgtattattagttggtagttggagtattgtagatggtaattgtaaatagtttttatttatttattttttttaaagaatgaaatatataaaagaaaaagattgtgttgtttggtgtaaagttagttaattattatatatttttttttttatttttttgtgttttagtgttgaagattaaataaagtaatataaaataaatttttaagaatttatagagttttattttaaggattgaaaagaaggttaaggtgtgttttttagtttatttttatatgtttttgtgatttggagatttattttgtagttaaaatgagttttgagatttgtatttttatgttttatttaatgattaggtttattagaagaattgagtttaaataattggggaagataattttttaaaaagagatttttaatttttgtttgttgatttttaaatttgttttattaagataagttttttgtgagaaatttggttgttagattttggaattggttttaatggttaattttataaattgagatgggagattttttttgatgggaggtagtttttatttttaaagtttatgttttagttggaatgtatatgttaaggatttttgttttggttaatttgggttttatattgtgagtatataaaaagtattatatggttaatggaggatgaggaattatggtaaagtaggtaggtaagttttaagaaataaaataatttgttaaaaaataatttttgatgattattgtaagattgaaagtgtaggaaaaatatagtttgaataattttagatttttttatattttttttttttttatatattttgttattttataataaaatttttaatggaaagtttaaaaataaatagtataggaatatgtgttttaaatgaattaaattgtgaaattagttagtaaattaatttgtagtaagtaattatttaaggaaattaaaatattgtttagtttagttttgtattttattatgtgtatgtgttttttataattaattaatataagtgttttaggaatatttgaagataaatatgtttaatttaaggaataaagtatttaaataatttaagtgtaattttgttgagttaaagtaaaatattttataaatgaagtggttatttaattttttagggaaagtttggttattgaaatgttgtatgtttatgttatattaataaaaatttttaatttattttgtttatgtgttttgtttttttgatattattggtatttgaattttagatggatttttgttaaaatgatattttgtgtgataaaagtatttttagttttgattgatagattaaaataaatgtaaggaaatttttttaaattagattaattttttataaaaatattttagaatgtatgaattttgatatttatatttataatggtaaaagttttttttgtttagtttagtaagataatatttatataaaagagtaaaaaaaaattatattattttatgatagtttgatttttaaattgtttaagaaagtaaagtggttaaattggaaaagaggaatatattttggaggtttagaattgaaaattttttttttaatttttagttggaaaataattttttgtatttatttaaagtgtattttttgaagtgttagattggagttgattggtgattaatttaaaggagttataatttaaagaaatggtgagagtttggtatttaggtttggtttttaggtaatttgtttgggtttgagaggttattaattgttagttaagatggaattttttttttttttttttttttttaatggataataatgggaagggggttaattttttagtagttgaaattttgtatttagttttttattttgagaatgttaatttttggtttgaggatttgtttttgtagtgttggtattgagatttaagggaagatattttgttttaaatgttagttatggtttggttttttttttgattttagtattttgtagattgttagtgtttgtggtgggggatgaaaggaatagggttttgtaaggtttgtttgttgattgtgttattttgggtgaaatttagttttaaaagttataaattatttatggtgaagattttttgaagtggaataaatttttagatttgtattattttatatttttgtgggatagatggtttttatttattggttattgggagagagttgttgtttttgtgttttattgttttttggggtgatttttagtgagttgagtttttggttgtatggtaagtgtttgaaagttgggtttgagaggattgtagggtttttgagggtgttaagttttgaaggagtttatgggtgtattggggtttttgaaatttagttgttattggtagtttttttttgtttttttttagtttttttgtttggttttgtattttttttttttttttttttttttattttttttttttttttttgtttttattttgtgtggggagtgatgtgatgttagtagagattttattaaattttattgtatagtggtgtgtgggtgttggtgagtttgttgtgtggttggtgatttaggagtgagtatagtgtttgggtgagtgttggggggagtgagtaggggtgatgagaaatgaggtaggggagggaagtagatgttagtgggttgaagagttgggagttggagttgggagagtgaaaggagaggggatttggtggggtatttaggagttaattgaggagtaggagtatggatttttattgtggaaaggaggattagaagggaggatgggatggaagagaagaaaaagtaatttgtgttaatttggtagttttaataaattaaagggggagtgttagggtagtggggagatagaaatgtatttttggggagtaaattaggatgggttgggaggaagtgatagggaaagtggtttaagagatggaataaaggataatgtttatggggttgtttgggatgaggtgtgtggagtgtgggtgtgagtgtgtgtgtgtgatttttttttaggtttgtagagttgaggaaagaggttatagtaaagagggattgtggagggaggaaagtgagagattggtagagggtgggagtggaggtgggtgtggtggggatgggagaggatgagtgaagagaaatttagaagaatggagtgagttagtgggagagggtgggagggttatagttgggagtgaatgagttaggtttgttagttggggaaggttgggatgttgggtttagtttagttgggatattgtgtttgaggttaaggtgggtggattaggtatgttgagagtgttggtgtataggtgggtatggttatgtattgatttagtgtttatgaagggtttgtattggataaggtttagatgtttatagagtttagaattttttttgttgtatttatatttaataagtttattttgggttatggatattttattttttaaaatgatgaggttaaggtttttggtgaggatggtattaaattgtatgggatagaagtgggggtgggggagagagttttttttaagtttatatttgtttttgtaaagtaaagagtatgtgaaattatagggtatatttttatttgaaaagtgtgttttatttttgaattttgattttttgattttttgatttgagtaaagatgtgtattttggtagtgagtagaatattttggttttgttttgtttttgagtggaaggattataaatataatttgtttggaggattaggtgtgaaggtttttgttaggtatatgggataatgtttttttaattttaagggtattttgttaatgtatgtttttggaaagtgttggaatatagttattgtttttggatttggatttttttattaatattaatttttgtttgagagtaaaatttaggtttgttattaaaaagatatttttttggtttttaattgagaataaagttttttttaaaagttgtattgttttttttaaattaatatattaatatttgtaattttagaaatatatagtgatttgggagaatgtgtataaaatagatatgtttaaaaaagtttggtgtttaaaattaattttagttattatataggtgttgggttttttttatttttgggggttgtttggaatatgttatgtgtttttttgaattattttgtgttttgaatttatttgagttagtagtaaaaataggtaaataaatttgtttaatttgttttgagtgttaaatttttttattttgaaatagttaatagttgatagatggatttattttatggaaagggttagtttttttagttatgaagaaaattgattagagatttatattttaagttatttttaatttttatgtaatatttgtgaaaatttaaattttttttttttatttagtggaaatttaaagtagtgttatttaaggggagagaaatgagggggaaaatgtttatgtgttgtttaattgtattttttttttgattttgagaatttttatttttggtttttgaaattttgttgaggtaagaaaattaaatttttttaataagttttataattgaattttagttataggatattggaaagtgtagtttgagaaagatatttttatttttgtttattgatgatttttgtagtttttttatttttttgagtaatgggttaataattttttttttttttttttttattttgtagagattaagaggtgtttgtagtagaatggttttgtttttagttggtggtgaggataggtaatt

SEQ ID NO: 687 - DNA, 19634 bp, Artificial Sequence
  chemically treated genomic DNA (Homo sapiens)
tttgttaaaaatataaaaaaaattagttgggtatggtggtgggtgtttgtagttttagttatttgggaggttgaggtaggagaattgtttgaatttggggaggtggaggttgtagtgagttgagattgtattattgtattttagtttgggtgatatagtaagattttgtttaaaaaaaaaatttagaatgtgtttatttttttttttattattttttttttattaatttgtttattttattagttatgttttgatagttttgatagggttgtgggatatagtagaaaggttggaaaggtatggatagttgtgttgggagtgttgtttgagtaattttttgtttttagttattttttattattttattaaatataattattttattatgttttgggtggtatgaagtaatttatggtaggatgttttttaatttagtgttaaaggtaatggtgtattttgagtttttttgttttgtattttaattttggaattggtaattttttatgattgatatttttgagtttttatttttttttatttttagggaatatttgaggaggtgaggttttatttttttattttttgtggtttaatttttgtttgttttttttttgttttgttttttgttttttagagttgagatttgggtatgtgtattagttgtaatagattggaggggattttgttgtttatttttttgttatttttttttttttttttttttgattgtttttatatttttgtttttatttttattttttatttttgttttgtatttgtttttagtttgggtttggggatttgttaggttggttttgatagttggggaattaatttgttttgtttatttttagttttgagttgtgtaggttttgtgtttttgtttttgtttttttttagtttttttgagtggaagttgttataaatggtttgaatgaaatgtgtgtgggtttagtgagtggtgaattattaggggattttgtttttttataaattagtatttttttgaggaggaggtgaaggagtgggaggaggtaatgagttgagagttgagttttgtgggtgtgtgtagtggttggagtgtgggggtgaggttgggttattttttttttttggttgtgtattgtttggtttgtggtggttttaggtattattttttttgtttgggttgagtttgttgtggtagtgattagtttttgtggttagtggtattgtttattgatgagtggtgttttttttttttttttttttttatgatttttttttttgtggtggtatgttgtttagtagtttgttttgttttgttgttaattttgagttggaggagaagtaattttggtagtggttgtggggttggaattttgtttttttttggtagtagtaggtttgtaagttgttggggttaggtggggtaagagttttgttggtgtattagtgttgttttggattgtttgtaatgtgtttttagtgagttgggagtggggttgtgattgtgagttgtttgggggagggggatttgtttttttttttttttagagattttggtttgtaattggattaaatgttgttgaaaggatgtaaataggtagagtaattgttattaagaaggttattatttttatttaaaggtagtgaggagtgtggggttttgtttgggtttttttgagttttaatagtaattaatagttaggtgttgattgtaattttttaaggttagttattgggagtagtttattttttttaggaattttggagggtatattttgttgggatttaatttggttgagaaatgtataagatgttaaaggaggaaggattatagggggtgtgtgtgtgatttttaagattgattttttgttattattttaatttttggttttttgttatttgggtgggggtgagtatgtgatatgtgtttaatttttagtagtaattttggtagtaggtgttgattttaattaagtaggagttgtggttgttgggtgtgtttttattaagttatgtgagttttgggtgtgttttttgtttgtatgttgtggttattgtttttgttattgtttaaggtgtttgttttttttgtttttggggttgtttttgtgtttagaaatgaaatttgtttgggggagagttgtgtatttatagtgatttagtgttgtggtagggatgtttggggattgggaaattttgtaagagatgttttgtgagtttgagtatttagggaggagtagggggtagtgttttttgtgggatttttttgggatttgttggtggttttgggttgtgatttggttgtaggtagaggggtggaggtgttggtagttggatttttgggatttttaattaggttatttggtttttggaggtggaaaggtgtttggggttaggagttttttgaaattttggggagagggaattttatggttttttagttttttttttagattttagaggaggaagagaagggttttagaggtgttggtatttttgggtgtagttaggagtagagtgtgaagatagtttttggagttagtgattttttttattggttaaggagagttgggaaattttagggtttttattataagtttttgtttaagatggttaatggattggtggggtatgaagggtggataattgtatttttgggttgggtgttggtttagaatggatttttgggtgaaggaatttatgagtttgggggtttttgttggggaaatagtatgaattggtgtgtgagattgaagaattttttttatttgttgatttaggagttttatggagtttatgtggttatgtgtttgtttgtggtgatttttgggattggtattattggtaatttggtggtgatgtgtattgtgtgttataattattatatgtggagtatttttaatttttttttggttaatttggttttttgggatttttttattatttttttttgttttttgttggttattttttatgagttgattaagaagtggttgttggaggattttttttgtaagattgtgttttatatagaggtaatgttttttaggggtttttaagttagtggttttatttgtttttgggattatagtattagagaattgttgttggatgtatttatttagttgaatgttttttttttttatttggggtttttttttatttttttttttaattatttatgtatgtatgtatatataaaaagaggtagttttgtgaaattatttttaaatttatttgtttttgggttgtaaaaaaaggatgattttataatatatagaattgtttggagtataaatttatttttttgaatatggtgttatgtgtatttttgatttggtatttgttagagattttagggttaagtaaatggttagtttaaggttgttattattagagtttataaggaaaaaaaaaaaaatattagtatttgtgtattagttattaagtgttttaatgtgagtttttttttaagaagattattgtatttttttttaaatagtaaagttggagtaatattttattgaaagaaagaaagaaagaaaattgtgtttgttagttggttttatgatatattaataattttttaaattagtttaagtgtttgattgttttttatgttattttatttaaatttttaagttattttttgtttttgtttttttttattttggttttttaattttatttttgtgtgtttgtgtgaatttaagtaaaaataagattttggttagtgtggtatataatttgtttaatatttttaaagttatatatttgttatttgttatgggtggaaagattggttattttaagggattgattttaagattagaaaattttttgggaagaagggggtatatttagtttttaaattttggaaataaaaattattttgagtgaaattgtattgttttattttatagttagtgttttggtttattattgtggtaggtggattttgttttttaaatggtttttttttaaatattagtttttggaaggggtttaattgttttgttgttagttgtgtttttagttagttggtttttgattttttttatttagattgtttattttatttatggaagtagaagaagggaaattgtaaatattttgtagtttttgattttgtttggtattagggtttgtgatattatgtttaatattgttttaggtttaaagttgggggataagtaaatagaaaatagtatttatttagatggattaaagttggagatagtaaataagattttttgttattttgatagggattaggtgtaggattattttatgattatgaaattagttgttgttgttttagtagtgtttatgattttttttgttgttaagtttggtgtatttttgaaatatttattttgtttggtagataatttatttttgaattgtgaaggagttagttgaatttatgttagagaatatgtgtttatttattaaattgtttttttaaggttagttttaaatttttttttttttttttttttttttattagaagaaattgatttatgtaagaaagagataaaagtataaagtggataagagaggtattttaatgatagagaagtgtattggtttattttattggaaatgtattggatatgtagaaatttgtatatattagagggaaaaataataggatagaaaaaggaaattggggaaagaaaaataaaaatattaaagtttttgaaagaatattttaaaagaaaagaatattaaatttaggaaagattataaaaattttggttaatttaatgagatataagtattttgagtaatggtatttattatgtatttattttaattttttttttttgtaattttgagtttgtataaatgtaatatttttttttatttgtattttattttttaatttaattagtttttttttaagagtgttttgttttttgttttttattattagtaaaattttttattttttgtatttttgtttaatttttttttattttagtagttttttttattttttagttattagtgttagtatttattttttttagagaattaaaggtttaaaaaatttatttatttattttttaaaattatagtataatatatatttttattgttaaaatagtgaatgaatattttaatatgtagtatttttatatttttatttaatttttattattttgaaataattttagaatggtttataaaaataattattggataatattgttggttttataatttttgattattgagaataagaattatagtttaaattttaaaataaaagtgtgtttttaggaggtattgatgtttttataaaagtaagaggtatttagggttttttttatgttgggtttttgtaaaaataggttttgagatgtagatttattggggtattaagtttattgggttgtgtttttaggtttaatttattaaggaaagaagaaagtaggattgggtgggtaaagggagaagttgaattgtgatgtaattgttatagagattttagttgatattattaggagttttagggttgggatggttatgtagttatattttaaattgaggtaagagggtttagtttttatatttttttatggattagttattagatgtaagatattggatgtaagtttgtttttaggatggggtataattttgagttgggtggatttttttggttaagggtaatttttagagagggatgtagttaagtattgttaattaatagttttagtagttggaggaattagtgttttatttttgaaggattttggagggagttgtttgggtggaaaattatagtatttattatagtagttttttttttttttttttttttgagatggagttttgttttgttattaggttggagtgtagtggtatgattttagtttattgtaatttttgttttaggggtttaagttattttgttttagttttttaagtaattgggattatgggtgtgtgttattatatttggttaattttttttgtatttttagtagagatgggtttttattatgttggttaggatggttttgattttttgattttgtgatttgtttatttttgtgttttaaagttttgggattataggtgtgagttattatgtttagtttatagtagtttttgaataattatgttaaattagatatagataatgttttaatttaatttttttattttaaagatgaaatttgaagtttagagattattttaaatatatatatttggttagtagttattagatttttggttttaatgttttatgtttatatttgttgattagattaatttgtatgaagtataagttttatttagtgagtgttttttttttttttttgttttttggtatttgaaaaattttttttttttttaatttattagataggaaaaaataaaaatttgtaaatattatttgttatataatgaaatgtatagttttttttgttttttataaattgttagtaagttttgtaattggtagttaattaaaattttttaaattgtagtaatttgagataattatattttttaatttgtttagtatgatgattttaatgattaaaaagttatataggttaaattttatgtttttaaaattatgaagtatgttagattggtgaaggatattataagtatattatatttgtttaaattttttttaaatttttttttaaaattttgtttttgattttaagatttttaaaaattttttgatattttgtttatttttatatttttaaattttgttatttttttatttgttatttttttattttattttttggttattttttttttttttaattatgtataatatttttttatagatttatgatgtagtatttattattttttagtaagatgtttaattttttttagtgtttttatttttaatttttttgtagttaattttaaattttatttttaatagattatgattgaattttataattttttttttttagttttttttttgttttattttttttttttattatagtttttttttttgtatagtttgagtgttagtataatttgaagggaattgtgggattttggggaagatttgggtttgtgtagaaaaatatgaggtattttttgagtaaaaattatattttttttaatttttatttaatttttttttttattttaatttgttggtttaaagtttgaggatagtatttagtttttaaggtttattgtgagaaaggaagttttatgatgtttaatattgttgtgagtgagaatgttttgggaattgttgtagttgatgatttttttttttttattttaggattatgatatttttatggtttaataataaattttataaagttgaaggataaatgaaatggtaggaaatgttagataggagagaagaaaatttggatagattatggttgtttttttagatatattagtttaaagtggtttattatttagttataagaaaaaaattatatttaaaataaaatttgtatatgtagtgtgtttttatgtgtattaggggaggtggagatatgtgtgggtgtggattgtaataggagaatggtagaggagttttttattatatttattatttatttaggaatttaataagtgtttaaaattaaataatttgggttaggtgtggtggtatatttttgtaattttagtattttgggaggtttatgtaggtagattgtttaagtttaggagtttaagattagtttggttaatagggtgaaattttatttttataaaaaatataaaaattaatgggatgtggtggtgtatgtttgtagttttaattatttaggaggttggggtaggaggatttttggagttttggaggttgaagttgtagtgatttatgattatgttattgtattttagtttaggtgatagagtgggattttgttttaaaaaaaaaaaaaaaaaatttaaataatttagatattaaatatggtaattggaatgaatttttgtttattatttaatggaagttagaattaaggtattatttgattgagattttagataatagattaaggtttgtttggatattaattggaggttttgaatgattgagattttttttagtttaaagaatttatatttttatggagtgttgtagaatagaaggttttaaataattataatgagataattttagatttaattgtatttttattttattgggataaaatttttgtatagaggtggagagagaataaagggaatatgttttattatggtttttggtttgggaataatttgtgataagtttagaattttttttaatgagaggaattagtttttttaatgattttagtaatattggttttaagttgagtggaataaatggtttttttattgttttagattgtagttagtattgataagaaagaaagggtttttggaggttgaagatgatagtgttatataattatttgagtttatatagatttttttagaatgtttgtatttaagtaatagaatatttattatggtatatggtaaattttttttgagaggtggattagttattaggtattttgttggatttttaagtggaaatttattgttttatgagtaattttaaagttattaatagtatttttagggaaaatgtgtttaatatatgagaatggtgttgaataaatattttatgattttttattaattttttagtaattattttatatatttttatgtaaatgaaaatatttagttgatgattttaataggaagaaaagtgttttttagagtgtatttttatttataattttatttttgaatggtgtatggtgaagttaattgaatttggattttttataagaaagaaaagttttataatatttaaataagaaatttaaatagtttttttttttattgattataatgagaatgtgtttttttttaaagtttgttaatgaagtataaataggaaaattgattttttaattttttttttatagatattgtttggtatttagtttttaaggattatatataaaatagtagtatttaataattgattaaagaataatttgaataatttattattttttgtaatttttttttataggtgttattatttgtttatttgtttattatttattgatttattaaatgtttatttggttttttttttatgtgaggtattattaggagtgggtaggagaaggtaatataggaagagggggaaaagtttttaaagatgaatattatagatgagttattgttattaaaattatagaaaagtaaagtaatgttttatattatgatgaatattataatagaggtttgaataaagtattgtggaagtttagaaatggtattgaaatgggttaagttatagttgtgtttgttatgattagagatggagaaattaaagggaaaattgtgttttttttaattttttttagttatatttttattattaatttttataaattttataaatgtttatatagtttagatttatgatgaaaagttataaatgtgaaaattttttaatttttgtttttttgttttttttagtttttttaggatagaaagtttataataataattggtaaaataatttagtaaatagtttagttttagaaattttttttaaaatatggaatttgtgttagtgtttaggatatttatttttgttttataattagtttttattagttataaggatattaaatatgttaaaattaaatattttatttaaatgaatggtttatttggtaatgtaataatagtatattaaattgagttttttttttttgaaaaaattaaaatatatataaattgtttaatttgattttggagaatttaagaaagaagatggataagggtgatattttagattttattgtggagttgaggaaaggggagtatgatgaatggatttttttaagaattggattaattttttaagtatataattagagtgaagatttattttgagtttttgagggtttttaaggtattttgttatgttagtaaagtatttttttatagagataaggaggtaaatgtgtttgtagaagtaaaatagatatgagtttataagtttattgaaggttgagtgggtgagggtttatttttgtttttatatttaggttgtatggattttgatataatttttatatttttaatggtatttgttttatgtgtggtaattttttaatagtattttattggaagtatatggatttgtgtttgggatgtagattgtgggagagggatgggaaggtagttatgtagtgtagtttgtttttgtttttgtatttttgttttattttttagggatgtgtttgttattttattttttatgaattgatttgttaaggtttaataatgaatttaattttgttgttaagattaatttttaaatattttaattggaataatattttttgtgttagaagagatgattttatttaaaattttagagtggagttgagaatgggattattgtaatgttaaatatggagggtttttttttatttgtagagtaagtgtaggtattttttataaatttttataaaatgtaggatatgattattgtgttagttttgtttttgagatagaatattttttatttgtgaatttgtaatagtttttagtgttatttgtttgtatatttgaatagtttatagtatttattaatgaggttaaggttattgatttgatttttgtttagaatgagatatttttattaggtttgtgattttatttagggatgttatttttttttttttttttgttaaaatagttttttttttattaatttttatttttagggtttatttttattattgtttttttaatttaaattttttttatattggaaaagtatttgataagttaatttgtattaagatatgtaatttagaaataattgttttttataagaagattgaattaagaaagaaatttttttaatagattattaatagtgaaattttggttaaaagtagataaattttgttttaaaatatggttttttaattttattaaaattatgatgatttaattatatataattttgtttttagtttgagtttatagttatgtaaattaatattattagttagaaagggaaataggtaaaaatgtgttattgttttttggaaatttattagaattttaaggtaaggaattgaaattttaggttattttaagattgattaggaatattataataatattaaagattgagaattggattgtgggtttgggggaaatattatattttgaaatgattttgtaattattgagaataaatatggaatttttagaatttaatatagatggtttatattttaagataaaatgttgttaattttgttttatttatatttttattttaataaatatttgatagattgataggaattataatatgttaggttgtagttaaatgaatttttttaattatataaggaatgtattgtgttatagatattataattggtaataaattttaatttaagataggattataaaggaaaagaggatttatggaattaagataagttttgggagaatatgttgatttttaaatagttttaaatggtttttaaaataaggaaagtgtggtattaagtttaggtaaaagaagagaaggtggagaatgaggtagtaaggatagttgatagttgatgtttttaaaatattttttttttatggtattgggaattatatgtaaatggaatagtttgagtatattagaaataaatggttatttattatatgtgggtatattagattaaatattagttgataaggataagaagttttttttttgattgtggaatagtggttgttagagttttgttttattttagagagtgtataagtagtgtgtgtatgaatgtaaggggtgaggaaagtttttttttttttgtttttggtttagaaatgttaattgaagtgtgttattgttatagtattatgatttgtatatattttaaaattaagattttttgtaaaaggttattttatttagagtagtttgataaatagtggttttgataaatttgtttttttatttgtgtttaaaaaagtattttttattgttgttttgaaatgttgtaaggataaggataatggaaaaatgtaagaagaagttaaaggtatagaagttttagttatttagaggttttattttgtgtttattttgttttttttttgattggttgttaggtttgtaattattgatataataggttattatttatagtttaaatgaatgggtttttttaataataatgtttttgttttgagggttatttgtaaataaaggatagtatataaatagatgtatttaaagattttttatgtaaaatataagttagtttagaatgtagttaataagaatttggttagaaatttttttattttataaaaattagtgtattttagttattttattgtatttgagtatgtagatttaattttataggaaggaaattttgtttaggatattgttttgttttttttttttttattggtgttattattgatttgtattggaaagttttgtgaaagatataatttattttatgatttgtattttatgggttttgtgttgtttattttatgttttatttttatttttaattttttttaatttgtttgtagttagtttttgagaaatgtagtagtagttaagataggatttttgtagattattggtttttataaagtatttatgggttttttttttatattattttgaatgaatagagatttaatgtagtataaagtggttatggtagtttaggttttttaggttttgatagttgttttaaattagaaatttgagtagtgggaaaaatgaaatttagttatattttgatttataaagtatgttttttattttttattaagtattttgttttataagtttttttttgtttgtattattttttttaagagaaatttagggaaatatgggatttgaaattattggaaagagtgatatattttttttttattttattaagagatagttttattttgaatttttttttaaagttattgttgttatgtaatttattgattgggttaattttttattggggtataaagtagttgttttaagttggatagtataggtgttgaattaaaatttgggatttatgattttataaatatatgtttaatagagggataaaatatttgaaagttgaggtatatttatggtttttataattattaagttgggtttttttaaatttagttttgttagtggtgataagggattagatgaggatttgtattatttttatgtaggtgattgtatttgtatttttttattattttaattaaattatttgttttttgttggtttttttttgtaataaaatttaaaaggtaatttaagaagttatttataaaaatttttattatatttttaaaattttttatattttataggttttttttttttattttgtggtagatttttatagtgtattatattagtatttataattaggggagaaatatatattattttgttttttattaagaaaattgaggtaaggagaaaatgagaattaatttgttagagtattgaatgttgtttgaatattgaatatttggaatgttatttgaaatatttggattattaaattgagttaattgtattttaattgtaattaggaataaatttttttagatgattttaaaatggagttttgttagttagaaaaatatttaaaatatagaatataataaaattattttatgagtgttttaagtttttagtatttattttttagtattttataaatttttaaatgagtaaatattgtaatagtataaattttatttttaaaattattattataagagaaaatttatttattatttttatattattatttaagagaaaatttaagaaatttatttaaattttaaatgatttatttaatgattttttaaatgattaaagtaatatataaagttaatggtaattttttttgggttattttttttttttatataggagtaaatttttataattttataagggttattatgtatgttaagagtaataaagagtatatttagatatgaattttgggtggtttttaagtttttttttttttttgtattatttttgtattttatggatttaaatagatattttagttaaaatataaattatgattgtattgtattgttaataaatagttaaattgataattataaggttattttagtttaatagattaagtaggatatagatgatatttgtaaagaattggattatattttttgaaatgtagttatatattaggagaggttttataatttggttagtttgtaaagttagttagatatttgtagtaatttttttaggagatattgtgaaattatgtttgttttttaattttgttaaattagtgatttttaattgtagtttttaggtaaatatggatatgttttagattaaggggagttatagtgagtatgttagaaattgttagttaattttttttgtttagtagattgtaatgagtgattttatatgtaaagtaatttgttggttgtatggtagtaggtgggagatagttgagaagttttgttatagattttagattttttgaggataaaatttttgttttatttattattgtttttagtagtagttatagtatattttatagatttttttttttttttttttaaaaataagatatatatatatatagtattgtgttaatgtagtggtttttttgttagtaatatagtgtttaataaaggtataataatgggaatagtttaggggtgattaagaagaatgattttaaattttttattttggtgtttaaagttttattgttttatatgtgggttgggtgggagttgaaggagttttattgttgttattttgggatataaagaaaagtagaatattgttgtttgaaagattttagagttgtttattttgatttttttttatttttgtattttaatgttaatttttttaaaatgtttaatattttattttttttaatagttaaaattttgtttttatttttttgttgattttgaaattattaaaattaatagttttgtttttgaaaagtgtttatagttttgtttttgttgttgttaattattttttttattgtagtttaattaataagagattgtattttatttatttagttttttaggatgttgttttaaagaattatttatttaagttaatgtttaatagttttatttttgagagtatattttatggtgatattgaattttagtaattagatatggttattaaatgtagaagatttggtgtttatgatgtagttttataattgtatataattgtattatttattttagaatttttaataagttgtatgtaaataagtatattttaaaattgtgatagaaatttttttatgttgttttaatatttaggaattttaattatatggatagattttatgtttgggtaagaagaaattagaatgttatttattatttatatgatttttattaattaatttttgaggtgtgtagttattattttatatatatttaaagttttttataaataatttggaaaagtattgatagggtttttgtatattttttgtttttttatattataaaatgtagtgtgtaagtgaatttatagaaaaaagatttgaagtaatattattgtaggtagtggtagtaggagagagtagatgtttaggattggtatttgggatgtagttgttaagagtaattgtattttaagtgttagttgtatttggagtagtgttattttttttggtttttttagtaattttttttgttgtttttgtgatttttttggattgtttattttgttgtagttggattttaattgtagagagtattattagagaaaagtttaatttgaaaatagaagtttggatgtaggagttttttgaaatttgtatatgaaaattggggaggattttttaatttatgatttattaaaaagattatagattatgtatgtttgagtttttgatttggtattaaagtttttgggaatatgattgaagaattgagtatttttagataaaatatagtgtagaatttttgatgataagttggaatatatgtaaattttgtttaatatttgttttggtttttgttgttttatgagattgaaggtaaagaatttggaaaaatattgttttgtttttttaggtagttaatattttttaattaagagtggatgtgtagtatagtttttgatatttaaggagttggtaatttaatatatttattttaatatatgtttattggtatgtatttgttattattttttattaaagattttgtaatttttggagttaggtatgtagttattagtatatgtgataattgatttatatttttttaatttgtggatttaaaattagggagattaatagagaagatgttattttttgtgtattgtgtgttttttgtaagtaatgatagaaaattattaagtaaatagatgttttgagtttttaaaagattgtttttttttagagtttttagtatttttatattattgagttttttttttaatagaaattttatttgtgattttaaaaggatgtatagtataaattttggaagttttgtatttgtggatttatttgggttataaagtgatggggaagtatgtataaagatttgttttagtgaagatggtatgaaagttttgatgagggtttttgatagtttaagaagttttgttttgtttttgatagatttaggagaaatgaattaaaatatttgaaaaattaatatataaatgttaagttttaaaaatttataaattaaggtattgtaatttttatatgatattgtttgatatagaattttaggaagtggttagttgtttttagatgtttttattaagtggtaattattggtattttaaaatatgattataagatagttgtataatgtggattttatttttagaattattttgtgtttttagtatagatgtaaaataaatttttattaatgtgaataatttttaatttgaaggttaattattaaaagatgaaagtggagattattttttgttatttgtagttatattaggttgatgttttatatgttaatgtttatgggagatattttgaaaaatttggagaataagaattgtggttattagtttaattgtgtttttttatttgtattgattagagttttgttagttatatttttttttttatttttgtttttaatatagttaatattttattatattttatttttagattgtttttattattagttatgagagtagttagggtataaatataatgtttttattttttatattagaattagtagatgttgtttgatatgtagtgtataaggaggaaatatttgatattggaattgttagaatttttaaggtaagttgttgtagttttggggagagtgatagtttgaatgtagtagataaataattaatgttttgagtattaaaattgtatgataaatggttttttttttgttaatattatttttttgatttttaaaaaatgagatattaatattatatttatattttttttgtttttttattagggaatagtttataattatgttttttaaatttttttattagtaggtaggggagagtaaaagtttatatttaagttgtttgggatgtagattaaagtattttatttatttagggagtttttttttagttttatattttatttgaaatgttattaatattttattttttatttattgtttttgtttaaatatataaataatgattatatttattatatattaaattatttaaaatttttttagaatatttaagtaggtttaatattgttaggtgattgttgtgtttatgttgtaattttgagaattattgtttttattttggttgattatgatatgtttgagggaagggattgttttttgtaattttttatttttttgatattaagtatagtgtttggtatagagttgatataaataaatgtgtgtttgtgttggatatgtatttgtttgttttatttgagtatatgtataatgtttaataaatattttataagtaaatgaaatgatagtatgtttatattaggaatatgtgtttatatttttggagagtttttatgtgaaaaaaaaataggtatatatttttggtttttaatttttaaatgttgatttttttagatgtttggattatatgtttataagagtagtgtttttttgaatatagttttttatgtggttattgttaaagagttttatgttttaaaatttttttgtgtttgggatatttagatattttttttggttattttttgtatatttttttgtatttttatatgttttattttagtattttttatttttttaaatttgatgtatatatttattttatgataaatatattttttatgtttgattttgtatttttggtatataaatttatagtggtttattgttttttgtatattgtgatttttgattttgtgaatttatgttttttgaattttaattataggattttttgaggtttggttttaaagtgtatttttttagagaggatttatgtttgattttaattaggtgtttgggattattttaaattgtattttgggttttttgagttatgtagattttggaaattttgattttaatattatgtaagtttaggtttttagttagaatttgttattttttttttttttttttttttagtttatttagatttaaattttgttatttaggtagatttttttattattttttttttttttttttttttatatttttaaagatgttagtatttgaggagttttaaatttatagggagtttttgatttaatttttatttatattggttttagttttgttttttgtttttgtgtatttgggtattttgttttatttttttagttaaaattaatttgaaatttttattaggattggtaggtgtttttagggtaaatatgtagtatgaagagggaggggtttttggtttgtttgaaatttgttttttttttgattttggtttttggagaattttttttttttgttttttgtaagtgtatgtttttgaaaataatattgtaatattttattttgtatttaggaaaaattggaggagttttttaattatttagtttattggagataataagtttttgagtgtttgttgtgtgtaaggtatattattgatttttatattggaaaatatgagtattttggttagtaatgaaaatgggaatttttgtattattttgattttttatttagattttttagtggtagatatttttgtggtgaataaaatttttagtgtatttgggttttgatttataataaaaagggattggattagttgatttttatggatttttttagttttaaatgttttgtattttatgatttttaaattattatagtgtgttttttttttttatgtttataatgatttagttgatgttttgagtttagttatttatgttttattttggaaaattgtttttttttttttttttatttttatttatttatatttttttttatagttttgttaatttgtatttattttttagtgttttgattttttgggggatattgggaataaatgttttttatgtttttttatagg

SEQ ID NO: 688 - DNA, 19634 bp, Artificial Sequence
  chemically treated genomic DNA (Homo sapiens)
tttgtgggggaatatagaagatatttatttttggtgttttttgaaagattaaagtattaggaaataaatgtagattggtaaaattgtaaaaaaaaatatggataaataaaaatgagagagagagagagaatagttttttagaatgaggtatgggtaattgggtttaggatgttagttgaattattgtaagtataaaaaaagaaaatatattgtagtggtttgagggttatggagtgtagaatatttaggattggaaggatttataaagattagttagtttaatttttttttattatagattagaatttagatatattaaaaattttatttattatgaaaatgtttgttattaggagatttagataaggagttagggtagtgtagaaatttttatttttattgttgattaggatgtttatgttttttagtgtgagggttagtagtgtgttttatatatagtaaatatttaagagtttattgtttttaatggattaaatgattggagggtttttttaattttttttaaatgtaaaataaagtattatagtattatttttaaaggtatatatttatggaaaataagaaagggaaattttttagaggttaaaattaaaaaggaaataaattttaaataggttagagatttttttttttttatgttgtgtgtttgttttaggggtatttgttaattttggtgagggttttaagttagttttagttagaaaaatggggtaaggtgtttaggtgtatagagataggaaatagagttggggttaatgtgggtggggattgggttaaagattttttgtgaatttggaattttttaaatgttgatatttttagaggtgtaaagggaaaaaagagagagagataatgaagaaatttgtttggatgatagggtttgggtttggatgaattgggggaaaaggagggaaaaaaatggtaaattttaattgggagtttgaatttatatggtgttaggattagaatttttaggatttatgtggtttagaaaatttaaaatataatttaaaataattttaggtatttggttaaaattaaatataaattttttttggaagaatgtattttaaaattaggttttaaaaaattttatagttaaaatttaagggatatgggtttataaaattaaaagttataatatgtaagagataatgagttattatgaatttatatgttaaagatatagaattagatataagaagtatatttattataaaataggtatgtatattaaatttaaagaaataggagatattaaaatagaatatgtaaaaatataagaaaatatgtagaaaatagttaaaaagaatgtttagatattttaaatataggaaaattttggagtataaaattttttgataataattatatgaaaaattgtatttaaaaaggtattgtttttataagtatatggtttagatatttaaaaaaattaatatttaaaggttaagaattaaaaatatgtatttattttttttttatatagaggttttttaggaatataaatatatgtttttaatgtaagtatgttattattttatttatttataaaatatttattaagtattgtatatgtatttaaatggggtaaatagatatatatttaatataagtatatatttatttatattaattttatgttgagtattatgtttggtattgagaaaatagaaagttataagaagtagtttttttttttaagtatattatagttaattaagatggggatgatggtttttaaagttataatataaatatagtaattatttggtaatattaaatttatttaaatattttggggaaattttaagtaatttaatatgtaataaatgtagttattatttatatatttaaataagaataatgagtagaaggtaaaatgttaataatgttttagataaaatatgagattaaaagaaaattttttgggtggatggaatgttttggtttatattttagataatttgaatataagtttttgtttttttttgtttgttggtaggaaggtttaagaagtatggttataggttattttttggtaaaggggtaggggaaatgtaagtataatgttaatattttattttttaaaagttaaagggatgatgttgataaaagggaaattatttgttatataattttagtatttaaaatattagttgtttatttattatatttaagttgttattttttttagagttatggtaatttgttttggggattttgatagttttaatgttaaatattttttttttatatattatatattagatggtatttattagttttaatatggaaaataaggatattgtatttatgttttgattatttttataattagtagtggagatagtttgaaaatgaggtataatgaggtgttaattatattaaaagtaaaaatgaaaaaaaaaatatggttagtaaagttttagttagtgtagataaagaggtataattgggttgataattataatttttattttttaaattttttagaatgttttttataaatattggtatatgaaatattaatttaatatgattgtaaatgataaaaaataatttttatttttattttttaataattaatttttaaattaaaaattgtttatattgatgaaaatttgttttgtgtttatgttagaggtataaaataattttaaaaatgaggtttatattgtataattgttttatgattatgttttaaaatgttagtaattgttatttaataaagatatttaagaatggttggttattttttaaaattttatattaaatagtattatgtagaaattatagtattttagtttatagatttttgaaatttgatatttgtatattagttttttaaatgttttgatttattttttttaagtttgttaaaaataaaataaaattttttaaattattagaaatttttgttaaggtttttgtgttatttttattaaggtaaatttttgtgtatgtttttttgttattttatagtttgaatgagtttataaatataaggtttttaaagtttatgttatatatttttttgaaattataaataggatttttattaaaaggaaagtttagtaatataaaaatattggagattttgaggagaggtaattttttagaggtttagaatatttatttgtttggtggttttttattattatttgtaaagaatatataatgtataaaagatagtattttttttattaatttttttagttttaaatttatagattgaaaaaatatggattaattattatatatgttagtaattgtatatttaattttaggagttataaagtttttaatgaaaggtaatggtaaatgtatgttggtggatatgtattaagatgggtgtgttagattattaattttttagatattagaagttgtgttgtatatttgtttttaattagaagatgttaattgtttaagaaagtaaaataatgtttttttaggttttttatttttaattttataagataataaaagttaggataaatgttaagtaagatttatatgtattttaatttattattaggaattttatattgtgttttatttgaggatgtttagttttttagttatatttttaaaagttttagtattaagttaaaagtttaaatatatatgatttgtagtttttttgataaattatgaattaaggaattttttttagtttttatatataaattttaaaaagtttttatatttaggtttttgtttttaaattgaatttttttttgatagtattttttgtagttaggatttagttgtaatagggtaaatagtttagaagggttataagagtaatagagaaagttgttgaaggagttaaagaaagtagtattgttttaaatgtagttagtgtttgggatgtagttgtttttggtaattgtattttaaatgttagttttagatatttatttttttttgttgttattgtttgtagtgatattattttagattttttttttgtaaatttatttatgtattatattttatggtgtgaaagagtaagaaatgtataaaggttttgttagtatttttttaaattatttataggaggttttaaatatgtgtaaagtagtaattgtatattttagaaattaattgataaaaattatatgaataatgagtggtgttttaatttttttttatttaaatatgaaatttatttatgtaattaaaatttttagatattggagtaatatgaaaagatttttattataattttgaaatatatttgtttatatgtagtttattaaaaattttaagatgaatagtgtaattatgtgtaattataaaattgtattatgaatgttagattttttgtatttaatgattatatttgattgttaaaatttaatattattatgaaatatgtttttaggagtaaagttgttaagtattggtttagatgggtagttttttgaagtaatattttgagagattgaatgagtaagatgtaattttttattaattaaattgtaatgggaggaataattaatagtaataaaagtagaattgtaaatattttttagagataagattattaattttgataattttaagattagtgggaaaatagaaataaaattttaattattggggaaaataagatattgagtattttgagaggattggtattagaatatagagatggaaaggaattaaaataaataattttaagattttttaaataataatgttttgtttttttttgtgttttagagtaataataataaagtttttttagtttttatttagtttatatgtggagtagtgaggttttggatattaaagtgaggggtttagggttattttttttgattatttttaaattgtttttattattatgtttttattgaatattgtattattagtaaagagattattgtattagtataatgttatatgtgtgtgtgttttgtttttaagagagaaagagagagaatttataaaatatattgtagttgttgttgggaataatgatgaataaagtaggaattttatttttaagaggtttggaatttatgatagaattttttgattattttttatttgttattatgtagttagtaagttgttttatatatggaattatttattatagtttattaggtagagaggattgattaatagtttttggtatgtttattgtgattttttttgatttgggatatatttatgtttgtttggagattgtagttgagaattattagtttaataagattggaagataaatataattttatagtattttttagggaaattgttatagatgtttaattaattttataggttgattaaattataaaattttttttgatgtatagttgtattttaagagatatgatttaattttttgtaaatattatttatgttttatttagtttattagattaggataattttgtgattgttagtttgattgtttattaataatgtagtatagttatgatttgtattttaattgaagtatttatttaaatttgtgggatataaggatggtataaaaaggaaagagaatttgaagattatttagaatttatgtttaaatgtattttttgttgtttttgatatatatagtaatttttgtaaagttgtaaaagtttgtttttgtgtaggaaaaaaaaatagtttaggaaggattgttattagttttatatgttattttagttatttagaaaattattaaataaattatttaaagtttggatgggttttttaagtttttttttaaatgataatatagagataatagataaatttttttttataatgataattttaggggtaaaatttatgttattataatatttgtttatttggagatttataagatattggagaatgaatattaagggtttaaaatatttataaaataattttattatattttatattttgaatgtttttttaattaataaaattttattttgaagttatttaaaaaggtttatttttaattatagttaagatgtaattggtttaatttaatgatttagatattttaagtgatattttagatgtttaatatttaagtgatatttagtattttgatagattagtttttattttttttttgttttagtttttttaataaggagtaaggtaatatgtattttttttttaattgtggatgttgatatgatatattatgaaagtttattataaagtggaaaaaaaaaatttataaagtatggaggattttgaaaatataatggaagtttttgtgagtggttttttgagttattttttaaattttgttatagaaagaaattaataaaaaataggtagtttggttaggataatgaaggagtataaatatagttatttgtatggaaatgatatgggtttttatttagttttttattattattggtaagattgaatttagagaaatttaatttggtagttatgagaattataaatatattttagtttttaaatattttgtttttttgttaaatatgtatttatgagattgtgagttttaaattttggtttagtatttatgttgtttaatttaagatagttattttatattttgatgagaaattaatttggttagtaagttatatgataataatgattttggggaaagatttagagtgaaattattttttgataaagtaagaaaaaaatgtattgttttttttagtaattttaagttttatgtttttttaggttttttttaaaaaaaataatataaatagaaagaaatttataaggtaaaatatttaataaaaggtaaaaagtatgttttataagttaagatataattagattttattttttttattgtttaagtttttaatttaaagtaattattaggatttgaggaatttgggttattatagttattttgtgttatattaaatttttgtttatttaaaatgatatgaagaaagagtttatgggtgttttatgaaaattagtaatttatagagattttgttttagttattgttgtattttttagaagttaattgtagataagttaaaaaagattaaaaatgagagtaagatgtgaagtagataatatagagtttataaaatataaattataaagtaaattgtgttttttgtaaaattttttggtataaattagtgataatattgatgggaaaagaaaaaatgaaatagtgttttaagtaaaattttttttttatgaaattgaatttatatgtttaagtatagtgaagtgattagaatatattggtttttataaaataggaaaatttttaattaagtttttgttaattgtattttaggttggtttatattttatataaaaaatttttaagtatatttatttatgtgttgttttttgtttataagtaatttttaaaataagggtattattgttaagaaaatttatttatttgggttgtgaatgataatttattatgttagtggttataggtttaataattagttaggaaaagaataggatgagtatagggtagaatttttaaatggttggagtttttatgtttttggtttttttttgtatttttttattatttttgtttttgtagtattttagggtagtagtgggagatatttttttgagtataagtgggggaataagtttattagagttattgtttattagattgttttgaataagatgattttttgtaaaaggttttaattttggagtgtatgtagattatgatattatggtagtgatatattttgattagtatttttaaattaaaagtagagaaggagagattttttttattttttatatttatgtatatattgtttgtgtattttttggaatgaaatagagttttggtagttattgttttatagttaaagagaagattttttatttttattaattgatatttagtttgatatgtttatatataataaataattatttatttttaatatatttagattattttatttatatgtgatttttaatgttgtgggggaaaaatattttgaaagtattaattattaattgtttttattgttttattttttattttttttttttttgtttaagtttgatattatgttttttttattttaaaagttgtttaagattatttaaaaattaatatatttttttaaaatttgttttgattttataaattttttttttttttatagttttattttgaattaaggtttgttattaattatgatgtttatagtatagtatattttttatatggttaaaaaaatttatttaattataatttaatatgttataatttttattaatttgttaggtgtttattaaaataaaaatgtaaatgaagtaagattagtaatattttgttttaagatataaattatttatgttagattttaaagattttatgtttatttttagtaattataaaattattttaaaatgtaatattttttttaagtttatagtttagtttttaatttttggtattattatgatgtttttagttaattttaaagtgatttggaattttagttttttattttggggttttgatgagtttttaaaaagtagtaatatatttttatttatttttttttttgattaatgatattgatttgtatgattgtgaatttaaattaaaaataaaattatgtatagttaggttattatgattttaataaaattgagaaattatattttaggatagaatttatttgtttttaattaaaattttattattggtagtttgttaaggaaattttttttttgatttaatttttttataaaaggtagttatttttaaattgtatattttgatgtgaattggtttattagatgtttttttgatataaaaaggatttgaattaggaagataatagtaaagataggttttgaagatgggaattgatgaggaaggggttattttgatagaaaaaaagaaaaaagtaatatttttgaatagagttatagatttaataagaatgttttattttaggtagggattaaattaatgattttggttttattaatgaatgttatgaattatttaagtgtatagatagataatattgaaaattattataaatttataaatggaaagtattttgttttaagaataagattgatatagtgattatattttgtgttttatggaagtttatgaaaagtatttatatttattttgtaaataaaaaaagattttttatatttgatgttgtagtaattttatttttaattttattttgaaattttggatgagattattttttttggtataaagagtattattttaattaggatatttaagagttagttttggtaataaggttgagtttattattggattttggtaggttaatttatgggaagtgaaatgataggtgtatttttggaggatggagtagaagtgtagaggtagagataaattgtattgtatagttgtttttttattttttttttataatttatattttagatataggtttatgtgtttttaatgggatattgttaaaaggttgttgtatataagatgaatgttattaaaggtgtaaaaattgtattaaggtttatgtagtttaaatatgaaagtaaaggtagatttttatttatttagtttttggtaaatttataagtttatatttgttttatttttgtagatatatttgtttttttgtttttgtggaaggatattttgttgatatggtaggatattttgggagtttttaggagtttagaataaatttttattttgattatgtgtttgagagattaatttaatttttgagaaagtttatttattgtgtttttttttttttgattttataatggagtttaaagtattgtttttgtttatttttttttttaggttttttaaggttaagttaaataatttgtatatgttttgatttttttagaagaaaaggatttaatttaatatattgttattatattgttaaataagttatttatttaaataaaatgtttaattttgatgtatttagtgtttttatagttaataaggattaattgtaaagtagagatagatattttaggtattggtataaattttatattttaaaagaaatttttagaattgaattatttgttgaattattttgttaattattattatggattttttattttgggaaagttaaaggaaataaaaaagtaagaattaaaagatttttatatttgtaattttttattatggatttaggttgtataggtatttatgaaatttatgaagattaatagtaagaatgtaattgaaaagaattagagggagtatagttttttttttaatttttttatttttggttataataagtataattgtgatttgatttattttagtgttatttttgagtttttatgatgttttgtttaaatttttattataatatttattatggtgtagaatattattttatttttttgtaattttaatggtagtggtttatttatgatatttatttttggaaatttttttttttttttttgtattgtttttttttgtttatttttaatagtattttgtatagaagaaaagttaggtaaatatttgataaattaatgaatggtgaataaatgaatgaatgatgatatttatggaaaaggattatagaaaataataaattatttaaattgttttttaattagttattgggtgttgttgttttatatataatttttaaaagttgaatgttagataatatttatagaagggaagttaaaaaattaatttttttatttatattttattgataagttttagaaaaggatatatttttattatgattaatggaaaaggaaattatttggattttttatttgaatattataaaattttttttttttgtggaagatttaaatttagttaattttattatatattatttagaaatggagttataaataaaagtgtattttaagaaatatttttttttttgttagagttattagttaaatatttttatttgtatgggaatatataaaatgattattaaaagattaatgggaagttataaaatatttgtttagtattatttttatatattgagtatattttttttaagaatattattagtaattttaaaattgtttataaaatagtaagtttttatttaaaagtttggtagaatatttaatgattaatttattttttaaagaaaatttattatatgttatgataaatgttttattatttgaatataggtgttttagggaaatttgtgtagatttagatagttgtatggtattgttatttttaatttttaaaaatttttttttttttgttagtgttagttataatttaaggtaatgaaagagttatttgttttatttaatttaaaattagtattgttaaagttattggagaagttggttttttttattagaaaagattttagatttgttataaattatttttagattagaggttatggtaagatatgttttttttattttttttttatttttgtgtaggagttttattttagtaaaataaaaatatagttagatttggggttattttattataattatttgaagttttttgttttataatattttatgaaggtgtgggttttttaaattaaagagaattttgattatttaaaatttttaattaatgtttaaatagattttaatttgttatttgggattttggttagatgatattttgattttgatttttattaaataatgagtaaagatttattttagttgttatatttgatgtttgaattatttgaattttttttttttttttttgagatagggttttattttgttatttaggttggaatgtagtggtatgattatggattattgtagttttaatttttaaggttttagaaatttttttattttagttttttgaatggttgggattataggtatgtattattatattttgttaatttttgtattttttgtaaagatggagttttgttttgttggttaggttgattttgaatttttgggtttaagtaatttgtttgtataggttttttaaagtgttgagattataggggtgtgttattatatttggtttaaattatttggttttaaatatttgttagatttttaagtgaatggtaggtatggtagagaatttttttgttatttttttattgtaatttatatttatatatatttttattttttttaatatatataaaagtatattatatatataagttttgttttgagtatagttttttttttgtggttaagtaataaattattttaaattgatgtgtttaggaggatggttatgatttatttaaattttttttttttttatttggtattttttattattttatttgttttttgattttatgagatttattattaggttataaagatgttataattttggaatagaaagggaaaagttattaattataatagtttttagaatatttttatttatggtaatattaaatattataaaatttttttttttataatagattttggaagttgggtgttatttttaagttttaggttaataaattaaaatagaaagaggagttgaatgaaaattagaaaaagtatagtttttatttaagaagtattttatatttttttatataaatttaaattttttttaaaattttatgattttttttagattatgttaatgtttaagttgtataggagaaagaattgtggtagaaaagaaaaataaagtaaaagagaagttgggagagaaaaattataaaatttaattataatttattgagaataaaatttaaaattaattatgaaaaaattaaaaataaaaatattgaaaaaggttaaatattttattggaaaatggtgaatgttatattataaatttataagaaggtattatatatagttaaagaaaggaaaaatagttaagaaataaaataagaaagtaataagtgaaggaatggtaaaatttagaaatatgaaagtagataagatgttaaaaaatttttaaaagttttgaggttagaggtaaaattttggaaggggatttggagaaagtttgaataaatgtaatgtatttgtaatgttttttattaatttaatatattttatgattttaagaatataaaatttaatttatataattttttggttattaaagttattatgttaggtaaattaaaaagtatagttgttttagattattgtaatttaaaaaattttaattaattattaattgtagaatttattgatagtttatgagaaataaaagaagttatatattttattatataataaatgatgtttatgggtttttatttttttttgtttagtggattaaaaaaagaaaaaattttttagatgttaaggagtggaaaggaaaagaaaatatttattggataaagtttgtgttttatataggttggtttaattagtaaatataaatatgaagtattgagattaagggtttggtggttattgattaggtatatatgtttaggatagtttttgagttttaaattttatttttaaaatgagggagttggattagaatattatttatgtttgatttaatatgattgtttaaaagttattgtaagttgggtgtggtggtttatgtttgtaattttagaattttgggatgtagaggtgggtagattataaggttaggagattaagattattttggttaatatggtgaaagtttatttttattaaaaatataaaaaaaattagttgggtgtggtgatatgtatttgtagttttagttatttgggaggttgaggtagaatagtttgaatttttgaagtagaggttgtagtgagttgagattgtgttattgtattttagtttggtgatagagtaagattttgttttaaaaaaaaaaaaaaaaaaaaagttattgtagtggatgttgtggttttttatttagatagttttttttaaagttttttaagaatgaagtattgatttttttagttgttggggttattggttgatagtgtttagttgtatttttttttaggaattgtttttgattaaagagatttatttaatttaaggttatattttattttgggagtaggtttgtatttaatgttttatatttaatgattggtttataaagagatgtaaaggttgagtttttttgttttaatttgggatatggttgtatggttattttagttttaaagtttttaatggtgttagttgaggtttttgtggtaattgtattatagtttaatttttttttttgtttgtttaattttgtttttttttttttttaataggttgaatttgagagtataatttaataaatttgatgttttaataaatttatattttagggtttgtttttgtaggaatttaatgtaggagaaattttaaatattttttatttttgtgaaaatattagtgttttttggagatatatttttattttgagatttggattgtagtttttgtttttagtaattaggaattatgaagttagtaatattgtttaataattatttttataaattattttaaaattattttagagtaataaggattaggtagaaatatagaaatgttatatattaagatgtttatttattattttaatagtaaaaatgtatattatattgtaattttaaaaaataaatgagtgaattttttaagtttttgattttttaagaaaaataaatgttagtattaataattgaaaaatagagaaagttattaggatggggaaaagttaagtaaaaatatagaaagtaaaagattttattaataataagaggtaaaaaataaagtatttttaaggaggagttgattaaattaaaaagtgaaatataaatgaaagaaagtattatatttgtataaatttagaattatggaaaaagaaaattaaaataagtatataataaatgttattgtttaaaatgtttatattttattaaattaattaaagtttttataattttttttgaatttgatattttttttttttaaggtgtttttttaagaattttggtgtttttatttttttttttttaattttttttttttgttttattgtttttttttttagtgtatatagatttttatatgtttagtatatttttagtgagataagttaatatatttttttgttattgaggtattttttttgtttgttttatatttttgttttttttttgtataagttaattttttttgataaaaaaaaaaaaagaaaaaaagaaatttgaaattgattttgaagaggtagtttggtaaatagatatatattttttaatatgagtttaattggtttttttataatttaaaaatgaattgtttattaaataaagtagatgttttagagatatgttaagtttggtaataggagaaattatggatgttgttaaagtagtaatagttgattttatagttatggaatgattttgtatttgatttttgttaagataatagagggttttatttattgtttttagttttggtttgtttaagtaggtattgttttttgtttatttattttttagttttaggtttggaataatgttgaatatagtgttataggttttggtgttagataggattaggggttgtggaatatttatagtttttttttttttgtttttataaatgaaatggatagtttgaatggagaaaattaagggttagttggttaaaaatataattggtagtaaaatagttgggttttttttaagagttggtgtttaaagagaggttatttaaagagtaaagtttatttattataatagtgggttaggatattagttgtaggatgaaataatgtaattttatttaaaatgatttttgtttttaaagtttggaaattagatgtgtttttttttttttaagaaattttttagttttagggttaattttttaaaatagttaatttttttatttataataaataataaatgtataattttgagaatgttaaataaattatgtgttatgttggttaaagttttatttttgtttaagtttatgtaaatatataaaaataaaattaagaaattgagatgggaaaagataggaataaaaaatgatttaagaatttagatgggatagtatggaagatagttagatatttaaattaatttgagaggttattaatatattatgaggttaattgataaatataatttttttttttttttttttttaataaaatgttattttaattttgttgtttaagaaaaaatgtaataatttttttgggggaaaatttatattgaagtatttggtaattagtatataaatgttaatgtttttttttttttttttgtaggttttgatgatgataattttaggttggttatttatttaattttaaaatttttgataagtgttaaattagaaatatgtataatattatatttagggagatagatttatattttaaataattttgtatattgtgagattattttttttttatagtttaggagtagatgaatttgaaggtgattttgtgaagttgtttttttttgtatatatatatatgtataaatgattggaaagagaaatgaaagagggttttagataaaaaggaaaggtgtttagttagataggtgtatttagtagtagttttttgatgttataattttgaaaatagataaagttattagtttgagagtttttggaaggtattatttttatatagggtatgattttgtaggagaagttttttagtagttattttttggttagtttgtggaagatgattagtggaaggtagaagaagatgatgagaaagttttagaaggttaggttggttaagagggagttggagatgttttgtatgtagtagttgtggtatatgatgtatattattgttaggttgttaatgatgttggttttgaagattattatggatagatatatgattgtgtaggttttataggatttttgggttagtgggtagaaggggttttttagttttatatgttggtttgtgttgtttttttggtggggatttttaggtttatggatttttttatttaaggatttattttgggttagtgtttggtttgggagtgtaattgtttattttttgtgttttgttagtttattggttgttttggataggggtttgtggtgggaattttggagttttttggttttttttggttagtaaaaaagattgttggttttggggattgtttttatattttgtttttggttatgtttggaaatgttagtgtttttgggattttttttttttttttttgagatttgaaggaagagttggagggttgtggggttttttttttttaaagttttagaaggtttttgattttgagtatttttttatttttaggggttaggtggtttggttggaggttttgggggtttggttgttgatgtttttgtttttttgtttgtagttgggttatggtttggggttgttggtaggttttaggagggttttgtaagaaatgttgttttttgtttttttttgggtgtttgggtttgtagaatgttttttgtagaattttttggtttttaggtgtttttgttgtggtgttggattattgtaggtgtatagtttttttttagataagttttgtttttggatgtaggggtgattttgagggtagaagaggtagatattttgagtagtagtagaagtagtagttgtgatatgtgggtgagaagtgtgtttggggtttgtatggtttggtgagggtatatttggtagttgtagtttttgtttagttaggattgatatttgttgttgaagttgttgttgagagttaggtatatgttatatatttatttttgtttgggtagtggggaattggagattagggtgatagtggaagattggttttgggggttatatatatgttttttataatttttttttttttggtattttgtgtattttttagttaagttgagttttagtaaggtatgttttttaaggtttttagagggaataggttatttttggtggttgattttgaaaagttgtaattaatatttgattgttgattattgttgagatttgggggagtttagatgaagttttatattttttattgtttttgggtgggggtggtggtttttttggtaatagttgttttgtttatttatatttttttgatagtgtttgatttagttgtaagttgaggtttttagaggaaaagaaaaataagttttttttttttagatgatttgtagttataattttgtttttagtttgttggaaatatgttgtaaatagtttgaagtagtgttgatgtgttggtgaaatttttgttttatttaattttagtgatttgtgagtttattgttgttgaggagaagtgggattttaattttgtggttattgttaaagttgttttttttttagtttaaagttgatgatggggtgaagtaggttgttggatggtgtgttgttgtagagaaggaaattgtggggagaagggggagaagagggtgttgtttgttggtggatagtgttgttagttgtgggagttagttattgttatagtgggtttagtttggatgggaagggtggtgtttggaattgttgtgggttaggtagtgtgtggttgggaaggggaggtggtttggttttgtttttgtgttttagttgttgtgtgtgtttgtgaagtttgatttttggtttgttgtttttttttatttttttgttttttttttggagagatattggtttgtggggagatgggattttttggtggtttattatttattaaatttatatatgttttatttaagttatttgtagtggtttttatttggaggagttgggagggaataagggtggaggtgtggagtttgtgtggtttgaggttagggatgggtgggataggttaattttttagttgttgaaattagtttgataggtttttgagtttgggttaggggtgggtgtggggtgggagtggggggtgggggtgggaatgggaatatgagagtggttgggggagggaagagaggagggtagtaggggagtgagtagtagggttttttttaatttgttgtggttgatgtgtatgtttaggttttagttttggggggtgaggggtggggtgggggaggggtggatgggggttgggttgtggggagtaagaaggtgaaattttatttttttaggtattttttagagataggagagaatgggagtttagaggtgttagttatagagaattattagttttaggattgagatgtagagtgagaaagtttaggatgtattattatttttaatattgagttgggaagtattttattatgggttattttgtattatttagagtatagtgaggtagttgtatttgatgaagtagtgggaaatgattggaggtagaaaattatttgaatagtatttttagtatggttgtttatgtttttttaatttttttattatattttataattttgttaaaattgttagggtatagttaataaaatagataaattaatgaagagaaaatgatagaggaagaaataaatatattttgaattttttttttaaatagagttttgttgtgttgtttaggttggagtgtagtggtgtgattttgatttattgtaatttttgtttttttgggtttaagtgatttttttgttttagttttttaagtagttgagattataggtatttgttattatgtttggttaattttttttgtatttttagtaga

SEQ ID NO: 689 - DNA, 15355 bp, Artificial Sequence
  chemically treated genomic DNA (Homo sapiens)
atttatgatggaattattttttatgagagtagttttgtatagttgttataggtattgatggatggttagtgtagggaaggtagggtagttgttggttttttatgatgtttatgaagttgttggggtgggttttttttggagaaggtggagatgtatggagttttgttttatagatggtatgggggtaaaaggagaggttgttggtggagattagttaatttttgggttataaataaatatatgaatgataagttaatggtggtagatgtatatgttaggtaatgggtaaaaattttattttttataaaaagattagtgtggataaagttattaaatttttttatggtgattaagggtaaattggggttttttgtttttagattttttttgtgatttagttttattgtttattagttgttgtttttgggtaggttattgaatatttgtaagttttggttttattaaaaatgatgataatattagtgtttattttaagggattatggtgagattatttgagataatttgtagtttaaaatatgttaatgatgagggtgatgatttttattttaagattatttgataattaatatgtattgatgattatatttattatttatatttataaagtatagtttttaggttgggtgtggtggtttatgtttgtaattttagtattttgggaggttgaggtaggtggattatgaggttatgagtttaagattagtttggttaatatggtgaaattttatttttattaaaaatataaaaattagtttggtgtggtggtgtatttttgtaattttagttatttgggaggttaaggtaggagaattgtttgaattgggatttgggaggttaaggttgtagtgagttgagattgtgttattgtattttattttgggttatagagattttgttttaggagaaaaaaaaaaaagtgtagtttatatgttagttttttggtttttttttggtttttttttttttagtttttagagttattagtattttttttttttaaatggtggggtaagtatatgttttaattaattttaatgtttattggttttgttttttaattttttgaggtgtaagtgatgtatttttatattaataatataagtttgtatgtagtggttatatataatgttaaaggtatattatatataatatggtggtttttgtgttttattttatattagaaaatagttaggatgaaaatagtttgtgtgtaagggatagatttattttttttgtgttatatgaagttatgtggaaagttgtagaatgggtaggaattaggtatagtttttataatgatttgttttataatattttttttgatatggtatttgttttttaaaaattttatttatttttattttgtgtttttttttttggttttagttttgttttttttagtaaatttagaagttttttttaatatattaattttttattttttttgttgtgtttttgaaaggttttttgtgtttttggttgtaggttttgaatgtttaggttatttgtgttatttgttttgtggtattttattaatgtaatgtgagggtggagggtagaattttggttttggttttttagtttttgtgggttttagttagattttaggtgttattttagtgtaattttggtgtttaatttgaggatgtgtgtggattagaaggagggattaaaatatgatttttttttttatggttagatgattaaatttgaagttttaaaaaatgtagtttggtttaaagttgtgtttaattgggaagagagaaaaatgttttggaaattttttttaggtttgggattatttttttttaattattagttattttataggtttgtggattgtgggtattatttgggtaggttgtgtttatttattatttgggaattttgtgttttggagttgttttttttttttttaaagtgtattttgtgtttttgttggaagaattgattataggtttgtttaattttttatagttttgaaagtgttataagtagtagttgttgagttatggttgaaggggaaattattatttttatagttttgattgagaagtttaatttgtttttagggaattataagaagtttaaatttttttattgtagtaatgggggttattttttgaggatttttttggatggtatagtggatgggataagggataggagtgattagtatagtaagtttatttttatggtattttttttttttttttgatattttttgtagttaaggtgggaggaaggtgtatatttaagtataggtatttgtttttttaaggttttatttaggtatgatatatttagaggtggagttatataaatgtgtaaaatgtttgggtttagaaaatagggatttgtgggggttattatttatttaaatgtgttttattttaagttttttaaagtattttttgttgatttaatagaatgggttgttggtgtttaattgttgtatgtttttttaggtttttgtaattagtgaaagatttggttttgaaggttagttaggggtttgtatgttttatgatgggatgaattagataggtatggtggtaaattttgtatagagatgtgggttttgttttaagttaattgatttttttggttatgtttttattgggtttgatttgtgaaattttagtttataattgtagttttatatattataaattatgtagttttttttttgtgtattatgtagatgtggttgtggtaattagtagtggtaaagttattttttagattttatagaaattggagagtaggagtgattagtgttaaatgttgaatattttttttaggattttttggtagtttggtttttagaggtgttgataaatgaaggtatgattttagagaaaagaatttttttgattatttaagtataaaaaaattttttttttttgttttggtatttttggtattggtgtgtatgtttgatattaggtgtttaggttttattgtgatgttatttgagattttttgagttttattgtagtattagaggttataaagaagtttaaagttagatttagtttttgtttagagggttagtaattttaagagttaaatttgttataaattaagagaaggaaaattaggagatatagaagaagataggtaggaaggaagtttttgtaggattggttttaaaatgtaatgtaaaatatttattttgatatgatggtttatatattaggtggttttaattatttatggattatgtattagaggttgtaggttttaagaataaatgattattttgttggtgtttatgttgtatttttagatgtataggtaatggggatggatgttggtgtttatatgaggtgatgttgtttttttttttttatttattgtatagattttggagatgaggagtaggaaggttgaggttggggtttgtagttgtagaattagtttttttgggttttgttttgatggtttatttttaaatgggtttgttgaatgttttatatttagtgaaaaataggtgttagaatgaggtaaaaaaaaaagattttagtttgttaaatagtatatataagtaatatttattgtaaattagtaaatttagattgtagtttattgtgttaggtatgatatataatttatgtgatttgttttatataatatgaataagttttaatttttttgggttttaagtgtttttaatatgttttaattaattttttgaaaaagtagggaatgttttttggtttttagaatttaagaggaaagataaattttatgatatgttttttggggttaagttagtttttttggaaattttgatttttggagtaaaaaaaggttttaatattggaatttttgtagtaatggaaaatggtttaattgttgttattttattattagtataatagattgtattttgggtgtgtaatattggtataatttttggagtttatagtggatttggttgtttgatttaagatgttaggagtttttagaaagtagtataatgtagttttgggagtgtaggtgaggatttttgtatttaaggaatgttagattattttttaagtgaatttgggtaattgtattttttatttttattttttttatttgtataaaaagaatattaatattttttgttttataggttttttgggagggttaaatgagataatatagtgagagtttttggtatagtggttggtatagaggaatagtatagtatgtgttggtttatattgtagttattattattaagttttttatataattagtttagtatatggtaatatagggttgtattgaaggattttttagatttttttttttaatagtattgttatttaggaaagttaaggggttagatgtaggtttagatttagtatttttttgttaatatttggagttgttgtgtgggtttattatttgtttattttggaattaagaataaggattaagaggatagagattagagtaagtggggtgggtggttagaagtttatttgtgtatttgttagtattggaattggatattttattgaagagttagtaggtttgagtttaagtttattttgtttttttttatttggagtagttttggataattaatgtttttgttattatgtattttttttgtttgtaaattttgtgaaagaagttttaagttttttagttttgggatgtttttagtttttttttgattagaaattgaagtgtttttagtgtttttagataatttttaggaaaattatttagttttgttgagatttaatttttttatttgtggaatgggaatggtagtattgtttagtgtgttttataagggtgaaatttttatttattagggttttgtaggtgagaggagttttgggtatggatgtattttttgaatgtggttttgttgtttttttttgtttagtggtggtattgttagagtttttttgagttttaagggttatttagaaatagaattgttttggttaggtatgagatggatgttttttgattaaatgtgatttatatggtttggtaaggagatatttttgattttttgattattagtttgagtataattagagattgaagtgatagagttatatgttaagattttttttagaaagagtgtttttaaaagttaattgaaaaatttaaataaattatataagatagaattgtatgtttttgagttttataaggtagaaataattttttttatggtttttttttgtttttaagttattgattatttttgggtaaatgtattttttttttatttttaggagaatgagtttttaagtatttaattttttttatagtggtataattttagggtagatgtttgtgtgtgggttgttttaatagagatttgagtaaaatgtttttattggtggatttttagtttgtagagaaggtggttttggtttgttttatttttattttttagattgttgttgtaggtaattattaatatggattgtgaatattggttatgttgttatgttaggaaggttaggtagaattagttagggagtgttgtatagattttagggttgatgggtatagtttgtgagaaggtttatgttgttttttaagttttagtttagggggatatataagtggtgttattatgagagggggaggttttggaagaagattaggtttaggggaagatggttagttttattttggatataagtattgaggagtgttttatgtattatgtagttgtttttagggttataattttttatttatttgtgtgattatttaatggtttttttttttattggatttttagaggataaggattttgttttttattgtttaatattataaattttgtgtttagtatattgtttgttatttggtaaaatgtttagtaaatattaatttgataagtgattgaattgtattggtggtagttaaatttaaagttaataatatatttaataaatatttatgagttttgatatgtgttaggtattatgttgaatttttttatttttatttaattataattttgagaagttattaattattattattttaagaatattgtagttgataggtgtgattagtttttaattgggagggtttggtattaattatattttttgtttttaggattaaggttttttttgtattttataattatttgatattaatattatgatagtggttttgttttataaattgatttaataaatatatttgtgttatggattagatgggtgtaggttgggttttaatattgttgtttattagttgtattattttgggatagttattttttaatgtgttttagtttttttgttttaaaaataagaatgataatagtatttatttataggaatgtaggagttttaatgtgataatgtttgtaagagtgtttagtatattgttaggtatataagtgtttaaaaaaaatggtattgattattatttttttgggatttttgagttttttttatttaattagttgattttttaagtttgttagattaagtgaatgttatgtttgtttgtagaattgagggtgattttttgttttagtttttttgggattatttgggttgaagtttttgaggtttgatatagaggtataatgtgtttagatataggtgtagtaagttttgttttattttatttttttggtagggtaagtttgttttgtgattgattttgatttttttggggagtttttttttaggtgaagggggattatgatttattttttaatgggattaataattgtaataataattagagaataatttttttataagtattttaaatttttagttgtttgttatatttataattttttagttttttaagtatgtaagagattatgtggggagtagaattattggtattatttattgtataaatggaaatgtttttaagtaaagtgtgtgttaattaaatatttataaattaagttatattttaaaggtgttagtagagtttattggttaaaataattttattttgtagttttttttaaagggtagatttttttttatgaaatgttttttgttttgttgttttaggggagtttagatttttattttttggttgggattatttagtatttagtagttaaggtattttattttttattaatatagatttgaagttaaaatagttttttaaatgattatgatggggagagttggattttattgttagaagttagagagaaggggaggtttttaggtaggaatgtattttgtgatagggtttttttattttggttatatgtgatgggaaggattttttgtttttttttttataatttttatttgattatatagaggatttttatatataaattttaaaatatatatatatatatatataatatattatatatattatatatatatgatatatatgtgtatatatattatatatatatgatatatatgtgtgtgtatatatatatatgttatttagtttttggattgtattaaaattttttagataatttttttagattttaaagaagtagatattttttaagataaggtttttttttttatatatatttatatatatgtgtgtgtgtgtatatatatatatatatatatatatatatatatatatagatgtgtatatatatttatatatatgtatatgtatatatatatattttttattattggaattatttttttttaaatttgatttttttttttttttgtttttttttaatgttttattaattttggtttgtggttatattttaattataaatgttattgatataaaataattgtattaatttttgaatgaggttgattttattttgggtaaatatggtaaaggatgggaagtttttaatttagaataaattaggtatataattttttttggtttttttttggagagtagaggtggaaagtaggtttagaggttatagatagatatgttatagaagtagaatttttttttttaggtattttttttattgaatgtattagttgtggttttattgttatatttgtttgggatgggataggaagatgttaggatagtttggggtttagaaatagggtgtaagattttaaagttgattttttttggtattggtaggattataattttttttttttttttttatttttggaaagtaagggattgttatttttattgtgaataaattattgttaagatttaatggaaggttttggggagtagaggagaaaattaaagttataaatttagttttttagataaaaggtgtgaatagtgagttgtgggttagtatagttatgtaaaagttttgggtttttttttatgtaggttttttaggtatgtagggatttgtgaagtagtttaaataatgagtatgggataaggaagattatgatttataaaggtgagtttgtatattttagttttattgatatgtagttttgataaataggttgtttttaaattaatattttttaatttatttttagtaaaggagtaggattttggattttattgtgggtatatatagttataaatttattaagtaaatatttttagttttttttttgtatatttttataatgttttatttgagtttgaatttttttaagaaatttttattgttagagtatttttttaaaagttgttttttatttttttagttaaattaattgttaatgtttttattttagaaggggaaaatgaagtattttatagattatggatgtattttgttttttaaaaagtatttgtttttttatttttgggatatttgagagatattgatttttttgtttatagatagtaatttttagatttttgtatgggataaagaagagtgtttgttttttatttgttttgtgtgttaatttggttggggggtattgaaaaagggagtggatagagaagttagagttttagaggtgttttatttatttgttttgtttttttattttttttgggtttttgtttgtttttaagaagatttattttttataagtgtttatgttttggtttagatgtaatatggatttaaatttaagttgggttataaaatattttaggggttatgaggaataaaaagtgggagttttggttagttttaagtgttttattgattatgaatggagttttaatatattagttattattttaaaatgtatgaaggagaattaggggagattatagtaaatttttgatgaaaattttgtaaaatatataaaataatatgtatagtttatgtatatatagtaaaatagaaaattatgtattagatatagattaaatattagtaaatattaggaattttattatttagagttttttagtgttattagttggttgtttttattttagaattgtttataaagaaatagagttaggatgaaggaaatatttttttaattttttttttagttttagttttttttattttttttaaagtagttatttgtatgaatttggttagtatttggtgtatagttttatattttattatagatgtatttatgagttatatatgtattgtgtttttttttttttttttttttgagatggaattttgttttgttgttaggttggagtgtagtggtatgattttggtttattgtaattttttttttttgggtttaagtaatttttttgttttagttttttgagtagttgggattataggtgtttattaatatatttggttaattttttttttttgtatttttagtagagatggggttttattttgttggttaggttggttttgattttttgattttgtgatttatttgttttggttttttgaatgtattgtgttttttaatatgatttttattaaggatttattatatttttttattgtaatttagttttttttattgtatgttatattttatttttttttgaaaggggattaaaaaaaaaaattatatatatatatatatatatatatatatatatatatatagagagagaaagaatgttgtagattttgtgtttttgtttgtttttagtttaaaaataattgtagtttttgttattgtgttgttgtattatttttaggtttatttgtttgtatttttaattatgtagaagttttaagtgtagggattatggttggtgttgagtgtaagttttagtatttagtaatgaatatgtgttgattgaatggttttttgttttttaattttgagttgttatttgaggaaaaagttgttgttgtgtggttagtttttttttttttttttaaggttttatttttttatgttttttttttttttgtttgtttttagtagtagttgtaagaggatgtaggtttggaaaattggaatgaagttatattagagagttggatattaagttagttatatgagttgtttagtttgggtgttgtttttttttgttagttttatttgtagaaggatatatgtttaggaaatttagttagaaagaaatttagtgaaaatgagttatgaaatttggatattttggagaaataatatttatagaggaaatttttgagatgaatttttattggtataataaatttggtgttgggatttatggttgagggttgaagttatgtgttaagtaggtttttggtttttgtttatttttatgaggtttttttatggttatgatggaattttatagatggtaaagttaattttatttagttttatggttagataagtgggtgttattgaaggtagtaaaatagaaatgtataggaaatgaaaagttttttaaaaattttttttgattggttgggtatggtggtttatgtttgtaattttggtattttgggaggttgaggggggtggattgtttgaagttaggagtttaagattattttggttaatatgatgaaattttgtttttattaaaaatataaaaaaaaaaaaaaaaaaattagttaggtatgatggtgtgtgtttgtaattttagttatttgggaagttgagataggagaattgtttgaattgggaggtggaggttgtagtgagttgagattatattatagtattttagtttgggtaatagagtgagattttattttaaaagaaagaaaaaagaaataaataaataaaaaaaatttttttgattatttaaaaagattttttttttggggtttttgttgtatttataatgtgtttgattaaatatttatatatatgggtgataggttgaaaagagttttaggtaattaattttattttattttatggttatagatgggattttggatggttatttattattttgtttatgtgtgattttgaatataagagggtttaagtaggagagtattgttggatttggattaatttatttttataattggagtttaagagattgtgtgaaagataggaaaaagtaggatatttggagtatttgatttggggtttggttatgattttttttttttttagaagtataatattgtgtaaaatatatttttattaaattttagttttttattaaaggatagagtaagtattatttttttttagggaatattttgaggagaaaaggttataaaagtatagaggaaatagttatatgagtattggttattttttatgtattagtttttataataatttttattatagataaggaaatagaggtaaatattttgtttgatgattatatagttaataggtagttaagtagaatttgagtttatgtagttgtgttttggagtttatattttttaattttatattgtttatattaagatagaaattagtatggtgtttggtatattgtaggtgattaataaaagttagtttttttttttgattttttttaaatatataggattatgttgagaaattgatataaaagtatatgtgaaggttttttgaaaattataaagtttgataattatttaaaaaaaaattagttttattgagataatatatatattatataatttatttatttaagttgtataatgtaatggatttttttataatttaatagagttgtgtaattaatattataatttattttagaatattttttaaaagaagttttatgttttttaattataatttttttatttttatttattttggttttggatattttgaatttatttgttgtttttatggatttgtttattttggatattttatttaaatggaaatataaaatatatggttttttgtgatgttttttttttatttagtattgtttttagatttatttgtgttgtggtatgttttagaattttgtttttttttattgttaaagaatattttattggtattttatgtatttatttgttttatagattgttagattgagaaataattttatggagattgagtgtaaatattttttattttattgaaaaagagattgtgtttaagaggttatgtagtttagttaagattatttagtttagagtttagttttgagttttataattttttatgtggttttattttattgttttttttagagagttattggagatataatttaaagtgtatagtttattgataatgggttaggagaattatttttgttaatattagtttaatattatttatttattaaataatgtagattgttttttgtgtgtagggtattgtaggaggtgttgaggattttagagggaataggataagatttttgtttttttttttagagtgtatatttttttgaggaggtagaaatagattagtagttttttagataataaaattattgtatgttgtattaagtgttatgaaagaaataaggggtagaggaggaggaggatgtgggggagggtggtattggtagggagaatggggtggggatgaaaggattttgtgtgtagagtgttatatattttggggagggttttttttaggatatttaggttgaggtttggaggagaaggattttgtgaatatttggaggaagaatgttttagagagaaggttatagtatgtgtaaagattttaggaaaatagggaaagtttgaagtttaataggagtagaaagagtgagtaagtggtgtgattgaaggtttgagagagtagggtttagtttatagtggaggtttataggtttgtttttttatggttatatttttagagttaattatttttaggaggatttgtgagaaagtgtattagtggtttttagtttttttttgtgaattaaataaattttagttgttattggaagttagaggaagttttgagtttttatagtaaagatttttaaggaagggagaattgtattttaggtaaaggtgatgaaattatgaattattttgggggtgaattaggagataaggaaggtaaagagaaataagaaaatataggtatattaatagagaaatggttaaataattatggtatagttatataatggaatataatttaattagtaagaagaaagaagtttattttttttattttgatgtagaaagatttataattagttgttaagtaaaaaaaaaagtaaggtgtagaattgtgtgtttagtatattattattagtatgagatagtatgttttttgtaatatatgtatataagttttttagaaaggatatatatataaggtgtttaggaggggtttttttgtttttgtatttttttaggagatgtgtattttagaatgaagttttttattattttttttgttgtttgggaaaatggaagtatattttttatttaaagaaattaaattaaaaatgaaaataggttaggtgtagtggtttatatttgtaattttagtattttgggaggttgaggtaggtagagtataaggttaggaatttgagattagtttggttaatatggtgaaattttatttttattaaaaatattaaaattagttgggtatggtggtgtatgtttgtaattttagttattggggaggatgaggtaggagaattgtttgaatttgggaggtagagtttgtagtgagttgagattgtgttattgtattttagtttgggtaatagaataagattttgttttaaaagaaaaaaaaaaaaagaaaagaatataaagaaaaggtaatgaggggttgagatttattaattaaagttttgtgtgttttagttttttttgttttttggtttttgttaagatgaattttagagatgtttttttatttttttagggaattaattattgggtagttattggtttttggtttagattttatttttagttgtaatgatggttgtgatggtttagtgattaaataaattattttgaagagtttagaattaattttaatttttaaatgtgaattattaaagtattttttttaagagggtattttagggtgaataaataagttaataattattaaatggatattggattttaattaagtgtttagtattttgggagtgttaattagtgtgaatgaggagagtgtgattttgtaatttatagttttttttttttatttttaggttttttaatttggatgttgttgatttttgggttggaaaattttttgttgttgggggttgttttgtgtattgtaggatgttagtagtatttttggtttttatttattagatgttagtagtatttgttttttttagttgtgataatagaaattgtttttagagattgttaaatgttttttttggagtaaaattatttttagttgagaattattgtttttattattgtatttttaggtaatggttttattttttttttattagaagttggtgattttttttttgtttttattttaggtgggttgttatagaggttgagggattgatggaaattttattgtgagggagtttattgagttttatatgtggtaattagttttaattttttgggaattttttttgttttagggaaaatagtaattttagattttataaaataatgatttgtggataggaattttttttatgattagaaggtttagataattaaaaggtaattttgtgtaggttgataatgaaagtagaatatatgtaggttggttagattttattttatggtattttaagattgtagggatgagggagtttgggggagtgagtgttatttttttttgtgattatttttttataagtgatagaaagaaaggagtgaggtattgtgaaggtgtatttagggttattttgtaattaatagggtggataggtaggtgagttggttgttgtttttttttttttttttaaggatgtaatttttaatggatagttttttttggaaggtaaagaaaaagggattgtatttttatgttttgattaatttgaggtttatttttgagggttttgtgaaatgaatgagtagaattttttatggttaattgttttggttgttgggttttattggtaaaagtgtagtgtttatttatttttgtttgtgttatttttattttagt

SEQ ID NO: 690 - DNA, 15355 bp, Artificial Sequence
  chemically treated genomic DNA (Homo sapiens)
attggaataaaaataatatgagtaaaagtaaataaatattatgtttttgttgataggatttggtagttaggatagttggttatggaaaattttgtttatttattttatggagtttttagggatgagttttagattaattaaaatatagaaatatagtttttttttttttgttttttaaagaaagttgtttattgggaattatgtttttgggaaaggaaggagagataatggttggtttatttatttgtttattttgttggttataaaatgattttgagtgtatttttatggtgttttgtttttttttttttgttatttgtaggaaaataattataggaggaaatggtatttatttttttgggtttttttatttttgtaattttgggatgttatagagtaggatttggttagtttgtatgtgttttgtttttattattaatttgtatagggttgttttttaattgtttgggttttttagttatgggagagatttttgtttgtagattgttattttataaaatttgagattgttgttttttttgagatagaagaggtttttagggagttaggattggttgttatatatgaaatttggtgaatttttttataatgaagtttttgttaattttttagtttttatggtaatttatttggggtagaggtagaggggagattattagtttttgatggggggagaatgaagttgttatttggaaatgtagtgatgagaatagtggtttttaattgggggtgattttgttttaaaggggatatttggtaatttttgaagatagtttttgttgttatagttagggggggtgggtgttattggtatttagtgggtagaggttagagatgttgttaatattttataatgtatagggtagtttttaatagtaaagaattttttagtttaaaagttagtagtgtttaggttgagaaatttggagatggagggaaaggattatgagttatagagttatattttttttatttatattgattgatatttttaaggtgttggatatttaattggaatttaatgtttatttgataattattaatttgtttatttattttagggtgtttttttgagaaaggtgttttgataatttatatttgggaattggaattaattttagattttttgggataatttatttggttattagattgttataattattattataattaggagtgaaatttagattaggaattagtggttgtttaatagttagttttttaggaggatgagggggtatttttgaggtttattttggtagaggttaaggggtaggagaggttggaatatatagagttttggttggtagattttgattttttattgttttttttttgtgttttttttttttttttttttttttttgagatggagttttgttttgttgtttaggttgaagtgtagtggtgtgattttggtttattgtaagttttgttttttgggtttaagtaatttttttgttttattttttttagtagttgggattataggtatgtattattatgtttggttaattttggtatttttagtagagatggggttttattatgttggttaggttggttttgaatttttgattttatgttttgtttgttttagttttttaaagtgttgggattataggtgtgagttattgtgtttggtttgtttttatttttaatttaatttttttgaataggaaatatatttttatttttttaaatagtagaggagatagtgaaaagttttgttttggagtgtatattttttggggggatgtagaaataaggaaattttttttagatattttgtgtgtgtattttttttagagagtttgtgtgtgtatattgtaaaagatatattattttatattaatggtaatgtattgagtatatagttttgtattttgtttttttttttgtttaataattaattgtagatttttttatattaggatggaaagagtaaatttttttttttttgttgattgaattgtgttttattatgtagttatattataattgtttaattatttttttgttaatatgtttgtatttttttatttttttttgttttttttattttttgatttatttttaggatgatttatagttttattatttttatttaagatgtaatttttttttttttggaagtttttgttatagagatttaggattttttttagtttttagtggtaattggagtttatttaatttataggaaggaattggaagttattgatgtatttttttatgggtttttttaggaatggttagttttgagagtgtagttgtgagggaataggtttatgggtttttattgtaagttgggttttgtttttttgagtttttagttatattatttgtttgttttttttgtttttattaaattttaaattttttttgtttttttgggatttttgtatatgttatagttttttttttgggatattttttttttagatatttataaggttttttttttttaggttttagtttaaatattttaaaagaggttttttttagagtgtgtgatattttgtgtatagggtttttttatttttattttattttttttgttaatattatttttttttatatttttttttttttttgttttttgttttttttatggtatttagtataatatgtaatgattttattatttagggagttattgatttatttttgtttttttaggaaagtgtatattttgagaggaagggtagagattttgttttgttttttttggggtttttagtattttttatagtgttttgtatatagggggtagtttatattatttggtgaatgaatggtgttgggttaatattggtagagatgatttttttggtttattattaataagttgtgtattttgaattatgtttttaataattttttgaggggggtagtaagatgggattatgtggagagttgtaaggtttaaggttgggttttgagttgagtgattttggttaggttgtatagttttttagatatagttttttttttagtaaaatgaggggtatttgtgtttagtttttataaagttattttttagtttaatagtttatggagtaagtagatatatggaatgttaatagaatattttttggtaataaaaaggaatagagttttgaggtatgttataatatagatgagtttggaaatagtgttgagtgggaagaaagtattataaaggattatgtgttttatgtttttatttaaatgaaatgtttagaataggtaaatttataaagatagtaagtagatttagggtatttagggttagggtgggtggagatgggggaattatggttaaaaggtatggggttttttttggaaaatattttaaaatggattgtggtgttggttgtataattttgttaagttgtaagaaaatttattgtattgtataatttaaataggtgaattgtatggtatgtgtgttattttaataaagttggtttttttttaaatggttattagattttatggtttttagagaatttttatatatatttttgtgttaattttttagtataattttatatgtttaagagagattaaaggaaggggttaatttttattgattatttataatgtgttaggtattatgttagtttttattttgatataaatagtataaaattaaagagtgtgggttttagaatataattgtatgaatttaagttttgtttggttgtttattagttgtgtgattattgggtaaagtatttgtttttgtttttttatttatagtgggagttgttgtaagggttaatgtatggaaagtggttagtatttgtatgattgttttttttgtgtttttgtggttttttttttttgaagtgttttttggaggaaggtggtgtttgttttgttttttggtgaagagttgaagtttggtgagagtgtgttttatgtaatgttatatttttaagaaggggaaaaattatgattagattttaggttgagtattttaagtattttatttttttttgttttttatataattttttgggttttaattatgggaatggattgatttaaatttagtgatatttttttgtttggatttttttgtgtttaagattatatatggataagatggtgggtggttatttaggattttatttgtagttatggaatggagtgaggttagttgtttgggattttttttaatttattgtttatatatgtagatatttagttaaatatattataggtgtgatagaaattttaaaggggaggtttttttaggtaattaaggaagttttttttgtttgtttgtttttttttttttttttttgagatggagttttattttgttgtttaggttggagtgttgtggtgtgattttagtttattgtaatttttattttttagtttaagtgatttttttgttttagttttttaggtagttgggattataggtatgtattattatgtttggttagtttttttttttttttttttgtatttttagtagagatagggttttattatgttggttaggatggttttaaatttttgattttaggtgatttattttttttggttttttaaaatgttgggattataggtatgagttattgtgtttagttaattaaagaagatttttaaaaagttttttattttttatgtatttttgttttgttgtttttaatagtatttatttgtttggttatggggttgaatagggttggttttgttatttgtggagttttattatggttatgaagaggttttatagaggtaaataagagttagaggtttgtttagtatatgattttagtttttagttatgagttttgatattaggtttgttgtgttggtgagagtttgttttaaaagttttttttgtaaatattatttttttaggatgtttaagttttatagtttatttttattagatttttttttggttaagttttttaaatatatatttttttgtaagtagggttggtaggaaggagtaatatttaggttgagtggtttgtgtagttggtttggtgtttagttttttagtgtgattttattttagttttttagatttatatttttttgtagttgttgttgaggataggtaaggaaggagagagtatgagaaagtggggttttggaaagagagggaggggttggttatatagtagtagttttttttttgggtagtagtttagggttgggggatagaaaattatttagttaatatatatttattattaggtgttgggatttatgtttagtgttagttatggtttttgtatttggggtttttgtatgattagggatatagataaatgaatttgggagtgatatagtaatataataataaaagttgtaattgtttttgagttaaaagtaaataaaagtataaaatttgtaatattttttttttttttgtgtgtgtgtgtgtgtgtgtgtgtgtgtgtgtgtatgtagtttttttttttaatttttttttaaagaaaggtagaatataatatatagtgaaaaaaattaaattgtaatgggagaatatagtaaatttttgatgaaaattatattaaaaaatataatgtatttaggaggttgaggtaggtagattatgaggttagaagattaagattagtttggttaatagggtgaaattttgtttttattaaaaatataaaaaaaaaaaattagttagatgtgttggtgggtgtttgtaattttagttatttgggaggttgaggtgagagaattgtttgaatttgggagaaggaggttgtagtgagttgagattgtgttattgtattttagtttggtggtagagtgagattttattttaagaaaagaaaagaaaaagaatataatatgtgtgtagtttatgaatatatttatagtaaaatataaaattgtgtattagatattgattagatttatataagtagttgttttgggaaggataagaggaattaagattgggagaggaattgaggaaatgttttttttattttaattttatttttttataaatagttttgaggtaagaatagttagttggtgatattggaggattttgagtgataggatttttagtgtttgttggtgtttagtttatatttagtgtatagttttttattttattatgtatgtatgaattatgtatattgttttgtgtattttataaaatttttattagggatttgttatgattttttttgatttttttttatatattttaggatggtagttgatgtgttaaagttttatttatagttaatgggatatttagagttggttaagatttttattttttgttttttgtgatttttgagatgttttatgatttagtttaggtttgagtttatgttgtatttagattagagtataggtatttataaaaggtgggtttttttgggggtagatagggatttaggagaaatggggaggtaggatgggtggatgaggtatttttaaagttttaatttttttgtttatttttttttttaatattttttgattaggttagtgtatagagtaaatgaagagtaagtatttttttttattttatatggggatttaggagttgttatttatgaataggaaggttagtgttttttaagtattttagggatgaaggggtaagtattttttgaaaaataagatatgtttatggtttgtagggtattttattttttttttttgaaatggggatattaataattaatttagttgaagaaatggaaagtaatttttaaaaaggtattttaatgatagaaattttttggagaaatttaaatttagataaagtattgtaaaaatgtatgggaagagggttggaagtgtttatttggtggatttgtgattgtatgtgtttgtaatagaatttagagttttgtttttttattaagaatgagttaagaagtgttggtttgaaaatagtttatttgttagaattatatgttaatgaaattgaaatgtgtaaatttatttttgtgggttatggttttttttgttttatgtttattatttaaattgttttatgagtttttgtatatttgggaaatttatataaaggggagtttagagtttttgtatggttgtgttagtttgtaatttattgtttatattttttgtttgaggaattaagtttgtagttttggtttttttttttgttttttaaagttttttattaggttttagtagtagtttgtttatagtaagaatagtaattttttattttttaaaggtagaaaaaaggaaaaagggttatgattttgttagtgttaagagaagttaattttgaggttttgtattttgtttttgagttttaagttattttagtatttttttgttttattttaggtaaatgtaatgataagattataattggtgtatttaatgaggaaaatgtttggagagagaggttttgtttttgtagtatgtttgtttgtggtttttaagtttgttttttgtttttgttttttaaagagaggttaagagagattatgtgtttggtttattttgggttggagattttttgttttttgttgtgtttatttaaagtgaggttagttttatttagaaattggtgtggttgttttatgttagtgatatttataattaaaatgtagttataagttgggattggtaaaatattagagaaagatagagaaggggaaaaattgaatttgggggaaaataattttagtggtaaaaaatatatatatatgtatatatatatatataaatatatatatatatttatatatatatatatatatatatatatatatatatatatatatatatatatatatgtaaatatatatgaaaaaaaaaattttattttaaaaggtgtttgtttttttaaggtttgaaaaagttgtttggaaaattttgatatagtttagagattgaatgatatatatatatatatatatatatatatattatatatatatagtatatatatatatatatattatatatatatagtatatgtgatatattatgtgtgtgtgtgtgtgtattttaaagtttatgtataaaaattttttatgtaattagatgagggttgtggggaggagggtaaggagttttttttattatatatgattgaggtgagagaattttgttgtggagtatatttttgtttggagatttttttttttttttgatttttggtagtggggtttagttttttttattgtggttatttgaaaaattgttttgattttgggtttatgttggtggggaataaagtgttttaattgttaggtgttgagtgattttaattagaaaatagaagtttggatttttttaaagtaatagggtaggaggtattttatgaagaggaatttgttttttagaaagggttgtaaggtaggattgttttgattagtgaattttgttagtgtttttaggatgtggtttgatttataaatatttgattggtatgtattttgtttaagaatatttttatttgtgtagtgagtggtgttggtaattttgttttttatgtagttttttgtgtgtttggggagttgaggagttgtgggtgtggtaggtagttgaaggtttggaatgtttgtgaggaaattattttttaattattgttgtagttattaattttattgagggataagttatggtttttttttatttgagaggaaattttttagaaagattagagttaattatagagtagatttgttttgttagaggagtgagatggggtggggtttgttgtatttgtgtttgggtatattatgtttttgtgttaggttttaggggttttaatttagatagttttagagaagttgggataaagagttatttttagttttgtgagtaagtatagtatttatttaatttaatagatttgaaaggttagttggttaggtgaggaaggtttaggaattttggaagaatgatgattaatattattttttttgagtatttatgtgtttagtagtgtgttaaatatttttataaatattattatattaaaatttttatgtttttatgagtgggtgttgttgttatttttgtttttaaaataaggaaattgaggtatattgagaagtaattgttttaggatgatataattggtgaatagtagtgttgggatttgatttatatttatttgatttataatatagatgtgtttattgaattagtttgtggggtggaattattgttatgatgttggtgttggatggttgtgggatatagaaggagttttaattttggaagtagaagatgtggttggtgttaagtttttttagttaggagttggttatgtttgttaattgtagtgtttttagagtgataataattagtaattttttaaggttgtggttaggtagaagtgaaggagtttagtataatgtttagtatatattagggtttatagatgtttattgaatatattgttgattttgaatttagttgttattaatataatttagttatttattaaattaatgtttattgggtattttattaagtggtaggtaatgtgttagatataaaatttgtagtgttgagtaatgagagataaagtttttgttttttaggagtttagtaggagggaaaattattaaataattgtataaataaatggagaattataattttgaggatagttgtatggtatgtgagatattttttaatgtttgtgtttaaaatggaattggttatttttttttggatttgatttttttttaggattttttttttttatggtgatattatttatgtgtttttttgagttgaagtttaggggataatatgaatttttttataaattgtgtttattagttttggaatttatgtagtattttttggttgattttgtttggtttttttagtatggtagtgtaattaatgtttatagtttatattggtaattgtttgtagtagtgatttaaggaatggaaatgggataaattaaaattattttttttgtaggttagaagtttattagtagagatattttatttaggtttttattagaatagtttatatataagtatttgttttagggttatattattataaggaaggttaggtatttggaaatttatttttttagaggtaggaagaagatatatttgtttaggaatgattaatgatttggggataaagagaagttgtgaaaggagttatttttgttttgtagagtttaaaggtatatggttttattttgtgtgatttgtttaaattttttgattggtttttagaaatgttttttttgaaggaagttttaatgtgtgattttgttattttagtttttaattatgtttaaattagtgattaaggaattaaaaatatttttttgttaggttgtgtggattatatttagttagggagtatttgttttatgtttggttgaggtaattttgtttttgaataatttttgaaatttagaagggttttggtagtattattattgggtagaagagggtaatagaattatatttagggagtatatttgtgtttaggattttttttatttgtagaattttagtaaatagaagttttgtttttgtgaggtatattgggtaatgttgttatttttattttataggtgaggaaattgagttttagtgagattaaatgatttttttgaaaattatttgggaatattagagatattttaatttttagttaggaaaggattggaagtgttttagggttggggggtttgaagttttttttgtagagtttgtaaatagaaagaatgtataatggtaagaatgttaattgtttagggttgttttaggtagaaaggggtagagtaggtttgaatttgagtttgttgattttttagtggaatatttagttttagtattgataggtatatggatgggtttttggttatttattttatttattttgatttttgtttttttggtttttgtttttagttttagagtaagtaaataataggtttatataataattttgagtgttggtagagagatgttgaatttaagtttgtatttagttttttgatttttttgggtggtagtattgttaaaaagaggagtttggaaggttttttaatatgattttgtgttattatatgttaggttgattatatggaaagtttgatgatgataattgtaatatgaattaatatgtgttgtgttgtttttttgtgttagttattgtgttaagaatttttattatattattttatttaatttttttaagaaatttgtgaggtaaggaatattagtattttttttgtataaatgagaaaagtgagggtgaaaggtgtagttgtttaagtttatttggaaaataatttggtattttttgaatgtagaaatttttatttgtatttttagggttatgttgtgttgttttttaggggtttttgatattttaagttaggtggttaaatttattgtggattttagaagttgtgttagtgttatatatttagagtgtagtttgttgtgttaatgatggaatggtaatagttaagttattttttattgttatagaaattttagtattggagtttttttttattttagaagttaaggtttttagaagagttagtttaattttaaggaatatattatgaagtttgtttttttttttgggttttgaggattggagagtattttttatttttttagaaaattggttaagatgtattaggaatatttaaaatttagaggaattaaagtttgtttgtgttgtgtggggtagattatgtgagttgtgtattatgtttgatataatggattataatttaagtttgttaatttgtagtgaatattgtttatgtatgttatttaataaattagagttttttttttttgttttattttgatatttgttttttattgagtataagatatttagtaagtttatttgaagataagttattaaaataaagtttaaaagagttaattttgtagttgtaagttttagttttagtttttttgttttttatttttagggtttgtgtagtgggtggggaggaaggaataatgttattttgtgtaaatgttagtgtttatttttattatttgtgtatttgagggtatagtgtgagtattagtgaagtggttatttgtttttagagtttgtaatttttggtgtatggtttatgaataattaagattatttgatgtataaattattatgttaaagtgagtgttttgtattgtattttgaagttagttttatagaaattttttttttgtttgtttttttttatgttttttgatttttttttttttgatttgtggtaagtttgatttttgagattgttgattttttaagtagggattggatttgattttaggtttttttgtaatttttgatgttgtagtgggatttagggaattttagataatattatgataggatttggatatttaatattaaatatatatattaatgttagaagtattaaagtagaaggaagagatttttttatatttagatagttaagaagatttttttttttagagttatatttttatttgttaatatttttgagaattgggttgttaggaagttttggaagagatatttagtatttggtgttagttgtttttattttttagtttttataaggtttggagaatgattttattattgttggttattatagttatatttgtgtgatatgtagagggaaagttgtataatttatgatgtgtaagattatgattatgaattgggattttataaattaagtttagtggaaatataattaggagagttagttgatttgaaatggagtttatatttttgtgtaggatttattattatgtttgtttggtttattttattatgaagtgtgtaggtttttgattagtttttggggttagattttttattagttatagaaatttgggaaaatatatagtaattgagtattggtagtttgttttgttgggttagtagagagtgttttaaaaaatttgaaataggatatgtttgggtaagtggtggtttttataagtttttattttttaaatttagatattttatgtatttatgtgattttatttttgaatgtgttatgtttgaatagaattttggagaagtaagtatttgtatttaaatgtgtattttttttttattttgattatagaagatgttagaaagggaaggggggtgttatagagatgggtttattgtgttggttgtttttgttttttgttttatttattgtgttatttggaaggatttttaggaagtggtttttgttgttatagtagaggagtttgggttttttgtaattttttggaggtagattaaattttttggttagggttgtgaaggtggtgattttttttttagttatggtttagtagttgttgtttgtggtgtttttaagattgtaagaaattgaataaatttgtagttggtttttttagtaaaggtataaaatgtattttgaagagaggaaggatagttttagggtatagggtttttgggtagtgagtaagtatagtttgtttaggtgatgtttgtagtttgtgggtttgtgaggtggttggtggttaaggaaggatggttttaggtttgggaggggtttttagggtatttttttttttttttaattggatatagttttggattaaattgtattttttagaattttaaatttaattatttgattatggggaaaagaattatgttttggtttttttttttggtttatatatatttttaaattaaatattaaagttgtattaaaataatatttagggtttggttgaaatttataaaagttgagaggttaggattaaggttttgttttttatttttatgttgtgttggtgaggtattgtgaagtagatagtatagatggtttggatgtttgggatttgtagttaaaggtataggaggttttttagggatataatagggaaagtaaagggttagtatgttaagggaagtttttggatttgttgggggaaatagaattggaattagggaaaaaggtatagagtgggagtaagtggggtttttaaagggtaaatattatattaaaggaaatgttatgagatagattattatgaaggttatgtttggtttttgtttattttgtagttttttatatagttttatgtggtatagaaaaggtgggtttgttttttgtatgtaggttgtttttattttagttattttttaatgtgagatagaatatagaaattattatattatatataatatatttttaatattatatgtagttattatatataaatttatattattaatgtgaaaatgtattatttatattttaaaggattaaaaaataaaattaatgagtattagaattggttaaaatatatatttgttttattatttaggagaaggaagtgttggtgattttaaaaattgaaaagaaagaggttaaaaagagattaggaaattaatgtgtgaattgtattttttttttttttttttgagatggagtttttgtagtttaggatggagtgtagtagtatgattttagtttattgtaattttggttttttgggttttagtttaagtaatttttttgttttagttttttaagtagttgagattataggaatgtgttattatattaggttaatttttatatttttagtagagatggggttttattatgttggttaggttggttttgaatttatgattttgtgatttgtttgttttggttttttaaagtgttgggattataggtgtaagttattatgtttggtttgggagttgtattttgtaagtgtgagtagtgaatgtgattattaatatatattgattattaagtggttttagaataaaaattattatttttattattaatgtattttgggttataggttattttaagtaattttattataattttttgaagtggatattaatattattattatttttaataaaattaaagtttatagatgtttagtgatttgtttaagggtaatagttagtaagtgatggagttgaattgtaaaaggagtttgggaatagaaagttttaatttgtttttgattattatgaaaaggtttagtgattttatttatattagtttttttatgaggagtggggtttttatttattgtttgatatgtatatttgttattattaatttgttatttatatatttatttgtgatttaaaggttggttagtttttattaatagtttttttttttgtttttatgttatttgtgaaataggattttatgtatttttattttttttaggagaagtttattttagtagttttgtgagtattatggaagattagtagttattttgttttttttgtattaattatttattagtgtttgtagtagttgtgtggagttgtttttataggagatggttttattataaat

SEQ ID NO: 691 - DNA, 5493 bp, Artificial Sequence
  chemically treated genomic DNA (Homo sapiens)
ttttagtaggaggggaatgttgggtatttgggtgtgggatttttggggaatagtttgtggtttggatttttgtatttatgaggggatagatgtggttttttttttggatgatggggtatttatagatgatggaggttagggttttttaataaaagaaggggtgtaggtgtgttgatttttttagagggttggaaggatggggtgtttaagggtgatatttatgagttttgggtttttgagggtggtttgtatgggggagagttgggatgattgagtttttaaaagagattttgatttggaggtggtttttaaatttttgggttttagtagagaaggggatttttgggtttgagggaggaggggttggggggtgggatttttgggattagggttgagatttggtttttaggtttggttttttggggtaataaaagttatagtttgggttttagtgtggtgaatattgaagttagggaaaggttttttgtttttagagttttaaggtagggtgggggtagagggtagtaatttttagttttggagtttagttttgaagttggtgtttttatattgggttttgagtttttgtttgtttgtttttagtttgatttttttttttttttttatttttagttttttatttttttgttttaggaggaaggtagaggttggtagttaggggtggggggtggttttttttttaagtttggtaggagaaggggtttttagggaggttaggagggggggttgtgggttttttggtagtggtagatggggattgaatgttaattgtattttgagtgagtgtgtgtgtgtgagaatatagtgagtgtgtgagttttttttgttttagtttttttaagttgtggttgttgttgttatttttgtttgtagttttttgtagttttttttggttattggtgtttgttgggggtgttgtttgggtaggttggtttggtttttaggggttttttgagtgtttgttatttgtttggtgaggatttgtgtgtttgggtgtttggggttggttggtggagggggggtgtgtttgtaagtgttgtggtggtggagggagggaggggtttgtttgtttgtattgattttgagttgtttgtttgggtgttgtggggtttttgttttttttttttggtttttttaaatttagatggatggtgtgtatttgggttttgtgttttttgtttgtgtttggttaggtgtttgggtgtttttggttgtttgtgtttttttgtttgtttaaatagtttttattagtagtggtagtttggtttttattagattttttattttgtgtgtgtgtgtttgtgtgtgtgtttttttttaagttttgggggtgttgagggggaattttagggaagtgagattgtgtgtgtgtgtgtgagtgtatgtgtgtttttgtttgtgtttgagagtgggggagttaagggggggtttagaggtggttaagtgaggaaggggtaagtagttttttaagtaggtaattttttgttttttatatgtatatattagttattagttttagaggtgatttagatagatagatagatatagatgttggaagggggggtgggggggttgagggtataaagtgggggtgtgagtgagttagggagaggtgggattggatatatggaaaggggggaggagttggggttgaagtggtagaggggggtattttgggtgggtggaggggggatttttatggggttggggtggtaagaggatattttgatagtttttgtaatgtttggggtttaatttttagagtaatatgtgtagttatgtttttgtttagtttaggtggttgtaattttgggggagagatagggtaggataggattaaggaagaggaaggagagatggagttagggatagataggaggtttgggttgttgttgttgttgttattattattgttgttgttttggggtttgttttttgatattggttttttgagttttttttggaattttggggttgttggatgttgggttttggttttggtttttttgttatttttttaatagaatagggttatgaaaaggtaaggtggggataggggatgtagggatggtggtgggaatgtggatttttaaatttaggatagaggaagttggtaagaagttttgtggagggagggggtttgaatggtgggtaggggttttgatttttatttagtttttttgttttttagggatttttttttattttttttttttttttttttgagttttttttttttgagtttttatattttagattttttatgtttttatttttttgatatttggttttttttttttatttttatatatttgatgttttatatttttgtgtttttatttttttattttattttttttttgtatttttttttttgtattagtttttttattgtgagttggttttttttttttttttttttgttttttttttttatgttagagttatgagtttgttattaatatttttgttaaggattttgagggtatttaggtttttagtattttttgttttaagtttttattttttttttaaggttttggaatatttttttagttttttttaagtattaggatttgggtggggagagattgatgttgtgtgtgtgtgttgggaggtgaggggggaggaaatgggatgttgtttgtagtataatttgaggttgtggggggagttgttgattgaagtggttgttttttttttttttgttggatgttgtggggggtaatgaagatagggatattttaggaatttttggtatttttttttttttttttgtttggggataggttgtgttatgtataggatttaagtggggtgattagggaggttagagtttggtgggggggtatttaggatgttgggaaggatagggtttgaaattaaaaggggatttttaagggaggataggagttggaatttggatttttgggtttttgggggaagaggggagttggggatttggatttttggtttttgtagggagaggaggttgggtattggagttttagagttttggggtaggaggggtttggttttttgggttttgggaaagaataggattgaatgtttagatttttaaggtttgggggaggaaggggttgttagaaggatttttgggtttttatgggaggaggtaggggatagtgtttttgtttgaggaaggtaggttgggagtttagttttttgagtttttgatagggtaggagatgagtgttggggattttagttttatgtagatggaagtggaaatggaggtttatgaggaggtagagatggaggtggggggagtggggggttgtttagaggttggattttgtgatttttgagggtgtgggttttgggggttgggtttttagagttttggaggattggggatgtttttttttaggttttggagtgggggaggttgttttttttaatttttgtggttaggaattgagtatgtagtttttgtgagaagggtggggttgggggttgtttttttgggttttagtagggagtgggatgtggggtttttaagagtagaagttaggtaggggtgggtttgggagaggtagaggaggggttggagggtgagtagttattgggaatggaggggagtgtgagtgttaattttgtgggggttaggttatagttgtgggttattttggggtggagtgggggggttattttgagtgttgattgagttagttgtttggggaagggtaatggaaaggaggagtgaagagaagttaggattggggagggatgggtatattaggagtttttaattttttttttggggagataggggtttgagatttttgggaaggtgaggtggtgggtagaggggatgggttgtggttttgaggtaggggaggggtggtggattttttttttgttttggttgtttgtggggtggatgaggtttgtgttattatggtaattagataggagtatgatagttaggagagaatttttttttgtttggatttttattttttttggaagtttttagtgtggattttagtttttttttgggaattaggagtttagatttttagtgttttttttttttagttttaggtaggatttaggagtttggtttttagtttaattattttaggtggttagtatttaatagggggtataggaagagaggttgtattttttttaatttattaaattgttttgggttgggtgttagggatttttatatttattttatttagttttttatagttgtgttttttaattttatattttagatggggttatgatttttttgttttgagaatgaggggatggggataggattaaggggataaaatgggttaggggttgtggttagggtgaggagtaaggttatgtggggattttttttttttggggtgttttattaatttttttttttttttttttatatatttgatttttttttttttttatttttttttttttttttttttttttttatttttgtttttttttgttatttgttttttttgttttatttttatgtttgtattgggtatttttttggtgggggttttgattttggttttgttttgttatttttgtttttttgtttttgttttgttttgtttgttttttttaattttaattgtttttttattttttatgtgtgtgtgttttttggtggttttggggtttttgtttttttttttttgttttgttgtttttttttttgtttaatttttttgttttgtttattttttttgtttttttgtatttttttttgtttttattattttttttttgggttttttttatttttgtttttgttattttgttttttttttttttgttttttttttgtttttgttgtttttgtttttttttttttttttgttgttttttttttttttgtttttttgggtttttttttgtttttattttgattttatttttgtgggtgtttttatttttattttgtttatttttttttttttttttttttatttttgtatttttttttgattttattatttatttttgtttttgtgttttttttaattttatattttatttttttttatttttgttttgttttatttttgtgtttttttttgttttatttttttttttggtgttttttttttattttttttttttatttttttttgttgtgtttgtttttttttttgtttttgtttgttttttttttatttttttttttttgttttttttttttttttttttttatttttttttatttttgtttgtttttttttttgttttttttttatttttttttttttttgttttttttttttttattttttttgttttttgtttttgtttttttttttgttttattattttgattgttttttgttttttttattttggtgtttgttttttgttgtatttttttttttgtgtgtttttttattttgtttttttgtttttgtgttttttgtttgtgttttttttttttttttgttttttttggtttgggtgtttaga

SEQ ID NO: 692 - DNA, 5493 bp, Artificial Sequence
  chemically treated genomic DNA (Homo sapiens)
tttgagtgtttgggttgggagagatggggaggagagggaggtatagatgggagatgtagggatagggagatgagataaagagatgtatagaggaggagatgtagtgagggataggtgttgagatggggaggatagggagtggttggggtgatggaatagagggagagataggaatggaggatgagagagatggaagggagagagatagagggagagagaaatggaggagagatagagggagagatgggtagaggtagagagagatggaggggagagagagggggagatggagagagagagatggaggagagataggtagagatagagggagagatagatatagtagagggaggtggaagggagaggtggggaagaaatattagaggaagaggtgaaatagggagagatgtagagatagggtgagatagagataggaagaagtggagtatgggattgggggagatgtaaagatgagggtggataatggggttaggggaagatatagaggtaagaggggagagagaggaagatagataaggtggggatggggatatttatagagatgggattaagataggagtagagagaggtttagggagatggggagggaaagagtggtaggaagaaggagagagatggaagtagtagagatggggagaagatggagagagagaggatggagtgatagaaataggaatgagggaggtttagggagaggatgatagaggtgggaagagatgtaggaaggtgggagagataagtgaggtaagaaagttggatagagaagaagatagtaaggtaggaagagggagatagagattttaaggttattaagagatatgtgtatataaaggatggggaaataattgagattgagggaggtaggtagagtggagtgaaaataggaggatagaaatagtgaagtaaggttaagattgggatttttattagggaggtgtttagtatagatatgaaagtaaggtggggaaggtgagtggtaggagggagtagaaataaaagggaggaaaagggagagaaaaaatgagagggaaaaggggttaggtgtgtggggagagaaagagagaaattagtggggtattttaaggagagaaaatttttatatgattttattttttattttgattataatttttaatttattttgtttttttagttttgtttttatttttttatttttaaagtaagggagttatggttttatttgggatgtggggttggggggtatagttgtggagagttgggtggggtgggtgtgggggtttttggtatttagtttagagtaatttggtaaattagaggaaatatagtttttttttttgtgttttttgttgaatattagttgtttggggtggttgggttgggagttaggtttttgggttttgtttgggattgagggaggagggtattgggagtttggatttttggtttttagagaaggattggagtttgtattaggggtttttagaaggggtgagggtttagataaggaagggtttttttttggttgttatgtttttgtttggttgttatggtagtgtaggttttgtttattttatagatagttagggtgggggaaaggtttattattttttttttgttttgaggttatagtttgttttttttgtttattattttatttttttagagattttgggtttttgtttttttagggaaggggttgggggtttttagtatgtttatttttttttgattttggtttttttttgttttttttttttattgtttttttttaagtagttggtttaattagtgtttagaataatttttttattttgttttaaaataatttatagttgtggtttggtttttgtggggttaatatttatgtttttttttatttttagtggttgtttattttttagttttttttttgttttttttagatttatttttatttggtttttgtttttagggattttgtgttttattttttattgaggtttaggagggtagtttttggttttattttttttatgggggttgtatgtttagtttttaattatagggattagggagagtagttttttttattttagggtttgaggaggggtatttttagttttttaggattttgaaggtttaatttttagaatttatgtttttagggattatagagtttagtttttggataattttttgttttttttgtttttatttttatttttttatgagtttttgtttttatttttatttgtatagggttaaagtttttaatatttattttttgttttgttagggatttaggagattgagtttttagtttgttttttttagatggaagtgttattttttatttttttttgtaaagatttaggagtttttttggtagttttttttttttttaggttttgggagtttgggtatttggttttgtttttttttaggatttaggaggttaggttttttttgttttaagattttggaattttagtgtttagttttttttttttgtaggaattaagagtttaggtttttagtttttttttttttttaaggatttaggagtttgggttttggtttttgtttttttttaaggatttttttttggttttaaattttattttttttaatattttgggtgtttttttattgagttttggtttttttagttattttatttagattttgtatatagtatagtttgtttttaagtggggaggaggaggagggtgttagaaatttttagggtgtttttgtttttattgttttttatagtatttaatagagaagagaggagtggttattttgattaatagttttttttataattttgagttgtgttgtagatggtattttgttttttttttttttattttttaatatatatatataatattggtttttttttatttgaattttgatgtttggaagaggttggaagggtgttttagaattttgaggaaggggtgggagtttggggtgaggggtgttgggggtttggatgtttttaaggtttttggtgggggtattaatagtagatttatagttttgatatgggaggggagagtgagaggagagagggagaggattggtttgtgatggggggattgatgtagggaggggggtatagggagaaggtgagatagagagatggaggtatagggatatggggtattaggtatgtggggatggggagagggagttaagtgttagagaaatgggggtgtgaaaggtttgaggtgtagggatttaggaaaaaggggtttagagagggagagagagagggtggaggagagtttttgagggataggggagttaggtgggggttaagatttttgtttattgtttaaattttttttttttatgaggttttttgttaattttttttgttttagatttgggggtttatatttttattattatttttgtattttttgtttttgttttatttttttatgattttgttttgttggggggatggtgggggggttaggattggaatttggtgtttagtgattttaagattttgaggagggtttagagagttgatgttggggggtaggttttggggtggtggtagtggtggtggtggtagtagtggtagtttggattttttgtttgtttttggttttgtttttttttttttttttttggttttgttttgttttgttttttttttaaggttgtggttatttggattaggtgaggatgtggttatatatgttgttttggaagttgggttttggatattgtagaggttgttggggtgtttttttgttgttttgattttgtggggattttttttttgtttatttggggtgtttttttttgttgttttagttttggttttttttttttttttatgtgtttagttttgtttttttttggtttatttgtatttttgttttgtgtttttagtttttttatttttttttttagtgtttgtgtttatttgtttgtttgggttatttttgaagttagtggttggtgtgtgtgtgtgaggagtgggagattgtttgtttggggaattgtttgttttttttttgtttggttatttttagatttttttttgatttttttatttttaaatataggtagaaatatatatatatttatgtatatatgtatgattttatttttttgggatttttttttaatatttttagagtttgaggagggatatatatatagatatatatatatagagtggggggtttaatgggggttaggttgttattgttgataggggttgtttggatagataggaggatataggtagttggggatgtttagatgtttggttggatgtaggtaggaggtatagaatttaggtatatattatttatttgggtttgggggggttggggggaaggagtgggagttttatgatatttaggtaggtagtttagggttggtatagatagatagatttttttttttttttgttgttgtagtgtttatagatatattttttttttattagttagttttagatatttggatatatagatttttattgggtagatggtagatgtttgagagatttttgggggttgggttgatttatttaggtaatatttttagtaggtattggtggttgagggaggttgtgggaggttgtgggtgagggtggtggtggtggttgtggtttggaggagttggagtgggagggatttatatatttgttgtgtttttgtatatatatatttatttgggatgtgattaatatttagtttttgtttgttattgttgggagatttatagtttttttttttggtttttttggggatttttttttttgttaggtttggggagggggttgttttttatttttagttattagtttttgttttttttttgggataagggagtgaggggttgaaaataaaaagggaggaagaagttaggttggggataggtaggtagggatttagaatttggtatggagatattagttttagagttagattttagggttgggggttgttgttttttgtttttgttttgttttgaggttttggaaataggaggtttttttttgattttagtgtttgttatattaagatttaagttgtggtttttattgttttagaaggttaggtttgaaaattaggttttgattttggttttaggagttttattttttagtttttttttttttagatttaggagtttttttttttattgggatttaggaatttggggattgtttttaagttggagttttttttaaggatttagttattttgatttttttttgtataagttatttttagggatttaagatttgtggatgttatttttgggtattttgtttttttagttttttgaagaaattaatatgtttgtatttttttttttattgagggattttggtttttattatttgtgggtattttattatttggaagggaagttatgtttgtttttttatagatgtaggagtttagattataggttgttttttgggggttttatatttagatgtttagtattttttttttgttagag

SEQ ID NO: 693 - DNA, 5605 bp, Artificial Sequence
  chemically treated genomic DNA (Homo sapiens)
ataatgatattgatggaaaattttattaaatagttataatgtatgttaagtattttgttttgtatattttttgttatattttaaggatgagagaggggagagttattttggttttggttgtgttttttttattttggttattttatgagttttttatagaggtttgaaatgatttggagtttagagtttatggttgttaggatatgattagggtgagtaggtagttgggattattttgatttttagttttttggtttttagttttttgggtattttattttgttgggggtttagtgattatgtttgggttttagagattattttttttttttatttttatttttagtttgttattaattaggtgggagtataggtatgtttttgaagataggtttagggttgtgtgatagttgatgattaggttgtagggaattaggttttatgtagttttattgttttttttttttttttttttttttttttttttgaggtggagttttgttttttgtttaggttggagtgtagtggtatgattttagtttatgggtttatgttatttttttgtttttgttttttgagtagttgggattataggtgtttgttattatgtttggttaattttttgtatttttattagagatggggttttattgtgttagttaggataattttgattttttgattttgtgatttgtttgttttggttttttaaagtgttgggattataggtgtgagttattgtatttggttattgtttttttattgttgttatagtttggataaaatatgatttttttgagttttttttttttttttaatatagagttttatttttgttgtttaggttggagtgtaatagtgtgatttttggttattgtaatttttgttttttgggtttaagtgatttttttgttttagttttttgagtagttgggattattgatatgtgttattatgtttggttagttttgtatttttagtagagatggggtttttttatgttggttaggatggttttgaatttttgattttaggtgatttattggttttggttttttaaaatgttgggattataggtgtgagttattgaatttagtttttttgagttttttgaatataattggggttatgtttgttttgtaggtttgttttaaggattaaagttgtttggggagtgtttggaggagggtgagttttgagttaatttttgtattttttttttagggttttttggtaataaattttaagtaaatgtgtattttgtttgtttttttggagtaggtttttgggtatttttgtgttaaattgatttttgtttttaaggtttttttttttttagaaattttgatgtagtttttaggtttttttgtagtgatagttatttttttttatttgtatgtagttgtagtgttttgtgggtatgttttttgaataataaagtggtttttttaaaggttgttttgtggggtttatagttttgttatttttagtttttgtagtggtttttgaatgaatgaaataagtgatggtgttttttttattattttatttttgttaatttggtaggtagggattttaggtgtgggttttggtggaggtggttttgtgaggtggggggatttttttaggtggggtgggggttttgggattatttttaggggttttttttttattttttggttttaatttgtagtgttttgttatttagggtttgtagggttttaagttttttttttttagtttgtgtgtttaggtttttgtttgtttttggtggtggttttggattttgagtggaagggggtggggggtgtgtggggttgggaagtggggagtgtgggtggtggaaggtggtgggagggggtgggggttgggaagtattgtgtgtgggtggtgggagggtttgggtggggttgtgtggtggttatgtggggtggggttgggagggtatttagggttggggttggtttaggttatggtggttgtagggttttggtaattgttttggtaatgttaattgttttgttgtgtgtaggttgggttgtaggtttttggttgtagtgttgggtgagtgttggggatttggggttattgtagtgtaagtgattttggtggggatggtgttatttggttgttgagatgggtttttttgtgtttttagttgggtttaggtgtggttttgtggtgtatttgggggttggtggggagttgggatttttgggattgtttttgatgggtgggttggggtgggagtttgtgtgttttgaagtgttggtgagaaaagtagaaaataattttgtttgttagttttttgttttttgtttttttttttgggttgtgtgttggattttggtttttggagtggggatgtggttaggattgttgagggaggtgtttgtgaggaagagtttggttgggtttggagattgttgtttgggattgtgtttttagtgtttgggttttggtgtttttgggttaaattgttgatataattgtatttgttggtatttatttttggtttattttttttttattgtgaaggatttgtttggttaattttttgtgtaagattttatgtaatttttgggattttagaagataggttttgttgaagaataggaatttggtattgggtgggttggggaggaagttgtatggtgttaaatttataaataggaagagaaattagatagtgaaattaagaggtgaatgggtgattggatgttggtggggagaaggttgggggtgtattttgtttttggattttagtaaagggaggttgggtagagtttttggggtgttattttttttttggttagtagttttggaggttggggggagttggtttttggggagtagtgggtgttgggtgtggggtgttgtaggtaggttggggtgggtgatttaggtggaagtgaattgtatttggttttttggtgggtttttgttattttttttttaggtgttgagaaagttagtaggttggtaaagaaaaggattttagtgtaggttttatatttttttttttaatggatgagagattttttaaatttattggagaagtgatgttgtggggtttaaatgtagatttggtatttttttgtagtttggaaaaatatttttattgtttgttgttggaggagaggatagttgagatgtattttttttgaatttaaatgtttaggaatgtaaggtgaagaggtttaagagggtgttggttggttttgttttttaggttggagtatagtggtgtgattttggtttattataatttttgttttttaaatttaagttatttttttgttttagttttttgagtagttgggattataggtgtttgttattatgtttagttaatttttgtatttttagtagagatggggttttattatgttgattaggtagattttgattttttgattttaggtgatttgtttgttttggttttttggtgagttatggtgtttggttaagaattgttttttgttggttttggtgttggtgatttagaatttgttagtttttggagaaaggggttgggttgtttattttgtgtagtttttttaaagatagagttaaatgttttttggagaatagaggtttttttttgtttttggttatttgttttttagttgggggtattttttggtggaaaggtataggttttttgttttttaggtggtaatgtaggttagatatggttttggtatagtttttttgggtgttggtttaggatagttttgtttttaattggttaggtggtgaggggtggtggttttttggttttaggttgaaattgtttatgtggtgttgatttagtagattggggaggttttttttgtaggtaggtttttttttttttttagttgttggatttgggagttggaagagaagttgtatttattttaggggtaatagatattttttgttgtttttggttggattgggaagtgaattgaagggaggttatgttttaggggtgttttgggatgtttgttagtgattttttttttttttttaattttttttttttttttttttttttttttttgagatatattttttttattgtttaggttggagtgtagtggtgtgattttggtttattgttatttttgttttttatgttgaagtaatttttttgttttagtttgttttttaagtagttgggattgttagtgtttattattatatttggtttttttttttttttttgtatttttagtagagatgggtttttattatgttagttaggttggtttttgaatttttgattttaagtgatttgttttagttttttaaagtggtaggattataggtatgagttattgtgtggtggaggggtaatttttttaaatttggtaatgagttgtggttgtgtagagtaatatattgtttttttgagatatggattgaaatattgagagggaggagttataggtatgttgatttttttttttttttttttttttttttttttgaggtggagtttgatttttttatttaggttggagtgtagtggtaagattttagtttattgtaatttttgttttttgtgtttaagttatttttttgttttagttttttaattagttgtgattataggtatgtgtttttatatttagttaatttttttatttttagtagagattttttgttttttttaaaaaaatttaatgtaaaaaaattttaatgtgggggttttgttatgttggttaggttggttttgaatttttgattttgtgatttgtttattttggttttttaaagtgttgggattataggtatgagttattgtgtttagtttgttgtttttttttaatggtttggtttaaggaaattattggaaatatgtgtggttgagtgatatttattgggtatttttatatggtttatgtaaagggagatggttggggtgataggtagttgagtttaggggaggtatgtatagatgtgttgtgtttttgggatattagggtggtaggtagtagtttttatgtttggttttaggttgtttgagaaagagtatgtgggaggtaaattttgtgttttggtatggttgttaatgtttatatttattttagtttgtgtggggtaggaggtttagggattaaattttattttgtgtttagatatttttttttttttttttttttttgagatagagttttattttgttatttaggttggaatgttgtggtataattttagtttattgtaattttattttttaggtttaagtaatgtttttgttttagtttttggagtagttgggattagaggtatgtattattatgtttggttaatttttgtatttttagtagagattttaaatgatttgtttgttttgttttttaaagtgttgggattataggtgtgagttattgtgtttagttatgtgtttagatttttaattaattttttttttagttttaagttttattgtttgtttttatagattatttttgtgtttgttttttgatttttttaagggttattgtattttttgtttgttgttttttttttggatttttttgtatatttttttgtttatgtatttatttatttattgtttgattaatgatagggttttgttttgttttttagg

SEQ ID NO: 694 - DNA, 5605 bp, Artificial Sequence
  chemically treated genomic DNA (Homo sapiens)
tttgggagataaagtaagattttgttattaattaaataataaatgaatgaatgtatgaataaaaaaatgtgtaggagaatttaaaagaggggtagtagatagggaatataatggtttttggaaggattaggaaataggtataggagtggtttatagaggtggatgataaggtttgaaattaaaaaagagattagttaaaagtttaaatatatggttgggtatagtgatttatatttgtaattttaatattttgggaggtgaggtgggtagattatttgaggtttttattaaaaatataaaaattagttaggtatggtggtgtatgtttttaattttagttattttggaggttgaggtaggaatattgtttgaatttgggaggtaaggttgtagtgagttgagattgtgttatggtattttagtttgggtgatagagtgaaattttgttttaaaaaaaaaaagaaagaaaaaaatgtttaaatatagagtggaatttgatttttaaattttttattttatataagttagggtaaatataaatattaataattatgttagggtgtaaggtttgttttttatatgtttttttttaggtagtttgggattagatgtagagattgttgtttgttattttgatattttagaggtatagtatatttgtatatgttttttttagatttaattgtttgttattttaattatttttttttatatggattatgtggaagtgtttagtaaatattatttaattgtatatgtttttaataatttttttaggttagattattgaaaagaggtagtagattgggtgtagtggtttatatttgtaattttagtgttttgggaggttgaggtgggtggattatgaggttaggagtttgagattagtttggttaatgtggtaaaatttttatattgggatttttttatattggatttttttaggagagataaaaaatttttattaaaaataaaaaaattagttgagtgtggaggtatatgtttgtaattgtagttagttgagagattgaggtaggagaatggtttgaatataggaagtggaggttgtagtgagttgagattttgttattgtattttagtttgggtgagagagttagattttattttaaaaaaaaaaaggagagagagaaaagaagaattggtatatttgtaattttttttttttaatgttttagtttatattttgaaaggatggtatgttattttatataattataatttattattagatttaagaaaattatttttttattgtgtggtggtttatgtttgtaattttattattttgggaggttgaggtggattatttgagattaggagtttgaaaattagtttggttaatatggtgaaagtttgtttttattaaaaatataaaaaaaaaaaaaaaagttaggtgtggtgatgggtattggtaattttagttatttgggaggtaggttgagataggagaattgttttaatatgagaggtggaggtggtagtgaattgagattgtattattgtattttagtttgagtgatagagggagtgtgttttaaaaaaaaaaaaaaaagaaagaaaaagaaattaagaaagaaaagaaaattattgatagatattttaaggtatttttgaaatgtgatttttttttaatttattttttaatttaattaagagtaatagaaaatatttgttatttttaaaatgggtgtaattttttttttaatttttaggtttagtagttggggaaagaaaagaatttgtttataaaaagagtttttttagtttgttaaattagtattatataggtagttttaatttggaattaaagggttattattttttattgtttaattagttggaaatagggttgttttgagttaatatttaggagagttgtgttagggttgtgtttggtttgtgttgttatttggggagtaagggatttgtgtttttttattagggggtatttttagttagaggataaatgattaaagatgaagggaagtttttgttttttaggagatgtttgattttgtttttgggaaagttatatagggtgggtggtttagtttttttttttaggagttggtgggttttaagttattagtattagagttaataagaaatagtttttggttaggtattgtgatttattgggaggttgagataggtggattatttgaggttaggaggttaagatttgtttggttaatatggtgaaattttatttttattaaaaatataaaaattagttgggtgtggtggtgggtatttgtaattttagttatttgggaggttgaggtaggagaatagtttgaatttgggaggtggaagttgtagtgagttgagattgtgttattgtgttttagtttgagagatagagttagttaatgtttttttaggtttttttgttttatgtttttgaatgtttggatttaaagagagtgtattttagttatttttttttttggtagtaggtagtgggaatgtttttttaggttataaaaaggtgttaggtttgtatttgaattttatagtgttatttttttagtgggtttggggggttttttgtttgttaggaggaggagtgtggggtttgtgttagggtttttttttttgttagtttgttggtttttttagtgtttgggaagggggtgatagaggtttattaggaagttaagtgtaatttatttttatttgggttgtttattttagtttgtttgtaatgttttatatttagtatttattgttttttagaggttaattttttttggtttttagggttattaattgagggggaggtggtgttttagggattttgtttggtttttttttattggagtttaggagtagggtgtgtttttggttttttttttattggtatttaattgtttatttgttttttggttttgttgtttggtttttttttttgtttatggatttaatattgtgtggttttttttttagtttatttagtgttagatttttgttttttaataggatttgttttttggggttttaggaattgtgtgggattttgtgtagaaagttggttaggtaaattttttgtaatgagggggaaataaattgaaaatagatgttggtagatgtgattatgttggtagtttggtttggagatattgaggtttaggtgttgggagtgtggttttaggtagtagtttttggatttggttgagtttttttttgtaggtgttttttttggtggttttggttgtgtttttgttttgagggttggggtttggtgtatagtttggggaggggagtggagggtagagggttggtgggtggagttgttttttgttttttttgttgatgttttggagtgtgtggatttttattttagtttgtttgttagggatagttttgagggttttggttttttgttggtttttaggtatgttgtggggttgtgtttgggtttgattgagggtgtagaggaatttgttttggtggttgggtagtattgtttttgttaaggttatttatgttgtggtggttttgggtttttagtatttatttagtgttgtagttgagagtttgtagtttagtttgtgtgtagtggagtggttggtgttgttggagtggttgttggagttttgtagttgttgtagtttgggttagttttggttttaagtatttttttggttttgttttatgtgattattgtgtagttttgtttgggtttttttgttgtttgtgtatggtgttttttagtttttatttttttttgttattttttgttgtttgtgttttttgttttttggttttgtatattttttgtttttttttgtttggggtttggggttattgttgggggtgggtgggggtttgagtgtgtgggttggggaagaggggtttggagttttgtgggttttgggtggtgaaatgttgtgaattggggttaggggatggggaaaaagtttttaaaggtggttttaaggtttttattttgtttagaaaagtttttttgttttgtgggattgtttttgttagaatttgtgtttgggatttttgtttgttgagttggtgggggtggggtggtggagagggtgttgttgtttattttatttatttagaagttgttgtagaggttgggggtggtgaggttgtggattttatagaatagtttttagaagggttattttgttgtttagagaatgtatttataaaatattatagttatgtataaatagaaaagagtggttgttattgtgaaggaatttaggagttgtgttaggatttttaagaggagaaggattttgggggtggaaattggtttggtataggagtatttggagatttgttttgagaggatggataaagtgtatatttatttggggtttattattgggaggttttggaagggagatgtaggggttggtttaagatttatttttttttagatattttttaaatagttttaatttttaagataaatttgtaaagtaggtatgattttagttgtatttaagaggtttagaggggttgggtttggtggtttatgtttgtaattttagtattttgggaggttgaggttggtgagttatttgaggttgggagtttgagattattttgattaatatggagaaattttgtttttattaaaaatataaaattagttgggtgtggtggtgtgtgttagtaattttagttatttgggagattgaagtaggagaattgtttgaatttgggaggtggaggttgtggtgattagagattgtattattgtattttagtttaggtaataagagtgaaattttgtattaaaaaaaaaaaaaaggtttagaagaattgtattttatttaggttgtggtgatagtaagagggtagtagttgggtgtagtggtttatgtttgtaattttagtattttgggaggttgaggtgggtggattatgaggttaggagattaagattattttggttaatatggtgaaattttgtttttagtaaaaatataaaaaattagttgggtgtggtggtgggtgtttgtagttttagttatttgggaggtggaggtaggagaatggtgtgaatttgtgagttgagattgtgttattgtattttagtttgggtgaaaagtgagattttgttttaaaaaaaaaaaaaaaaaaaaaaaaaaggaaggtagtaggattgtatgggatttggttttttgtagtttggttgttagttgttatatagttttgagtttgtttttagagatatgtttgtatttttgtttggttagtaataaattaaggataggagtggaaggaaaaaataatttttggagtttaaatatggttattaagtttttagtagagtgggatatttgaggaattgaggattaggaggttggaggttaaggtggttttaattgtttgtttattttagttatattttgatagttatggattttggattttaaattattttagatttttataaggagtttataagatggttaaaatggggaggatatagttagaattaggataattttttttttttttatttttagagtgtgatagaaggtatgtagagtagagtgtttgatatgtgttatggttatttgatggaattttttattagtgttattat

SEQ ID NO: 695 - DNA, 4394 bp, Artificial Sequence
  chemically treated genomic DNA (Homo sapiens)
aaggatgaggtttatttgggtattttgggtatagggagtgttgttgaaaaaaagttaaatattataaaatatttgaagatatttattttgagtaaatgtgaggattatgatttgtgaaattattttagtaggttttgagaatatgtgagtaaggtggttgggtaatagtttggttttatatttttttttaaaatttttaggttttttttgtagagatagggttttattatgttgtttaggttgattttaagttttttagtttaagtaatgtttttattttggtttttgagtatgttgggattataggtaatagttattatgtttggtttggttttatggattttatagagatagatgttataggttaaaattataaattaatatatgtaagatatatattggtttagtttagaaatagggttggtaggggtagtttttaggttataggggatttaaagattttttgattggtaagtggttgaaagagttatgttttgtttaaagagttaaagtgggattatttatgtttgtaattttagtattttggaaggttgaggtaggtagattatttgaggttaggagtttgagattagtttggttaatatggtgaaatattatttttattaaaaatataaaatatatatatatatatatatgtatatatatatatatatatatatgtatatatatatatatatatatgtatatatatatatatatatatgtatatatatatatatatatatgtatatatatatatatatatatgtatatatatatatatatatatatatatatatgtatatatatatatatatatatatatatatatatgtatatatatatatagtgtatatatatatgtatatatatgtgtatatatatattatatatgtgtgtgtgtgtatatatatatatatatatgtgtgtgtatatatatatattagttaggtgtggtagtatgtgtttgtaattttagttatttaggaggttgaggtaggagaattgtttgaatttaggaggtagaggttgtagtgagttgagattatgttattgtattttagtttgggttatagagtgagattttgttttaaaaaaaaaaaaaaaaaaaaaagagttgatgtgagtggataaaaggtgtttgattttttaagggaaggagtttttttagaaaatgtgaattttgtttttttaagagatagttgtgtagtgttatattaaaatatgtgaaaggaatgtattttagggtggaatattttgtttgtttttgggtttgttgtttgttatgtgaggttgtgttagtgtgaggttggaatttgggatttggaggttagagttattggtgaggtttgagtttttaagtatagtgtttagagggagagggtggagtgggtttgattttttttgtggtagggtttgagttggttttttaggtttttttggaagttttgtagaggagtggagggtttatttggtgggttggggattttgaatttaattttggtttgtaagaggtttttagagaggatgtttgggagtgttttggagggggatgagggggtgttgggaggagtaggtgtaggagtttatggtgtagtgttttgtgtaggtttggatgtggggatggttgtggtggttgggataggggttattttgtggggttttttagggtgggttgttttatgattttaggttaggttgaaatgggaattttttagattttagaagttgggttgggttgattttgtgggtgtgagtggtgggaattgtaggtgtggtaggtgtattattattttgttttttgtttgggtgttgtgtgtgtgtgttgaggttgttttgtttaggttaggttttgttttgttttgttttgtgtatgttggttgtgtttatgtgattggtttgggtgtaaatatgtgggttagttgatttggtttaattgtggtgttattttggttataagtgtatggttttggtgattttttttgatttggttgttgttgttatgtagttttttagttttttgttgtttgttttttgtttgttggttgtatttgtttttgtgtttgttaggtgaagttttaggggttggggtttagggatgggtaggggttgtggtgttgaggttttggggtttgtggtgatttttgtgtttttttgtggtttttatgagttttttgtgttttttgtgttggaatgtatttgtgttgttttgtgtggttttttgtatggattatttgtttatggggtgttgggttttggaggtgtaggggatttggggtagaggtgttagatgttttttttttatatgttattttgggttgtattttgaggattgtagattgattgtagtttttttggagatggggtggggtggggggaggtagtgtttatttggggtaggtggaattggggtttgtattgagtgtttttgttgttggagatttaggttaggttttagagtttttgagtttgggtgagtttatttttttagggatttttttattatttgtgaattgggggttttaaaagtttgttttagtggtttttattataggttttgggttgggagattttttgagattttaggagtttttatgtttttgagagaggaggaggtatggggagtgggttggtttatttattttgggtttggggttgtgttgtagtgaggtttatatgttttttaggttgattttttgtgttaggtgaggttattgattgggtttggatgggatggggtttggttatgtttgattagttgggtagaggagggttatgttgtagtttgtttttttgattttttttttagtttttgtaaggtagtttgtatttttaggaggggtatgttgatttattttattgggtatttgttttatttttgttttgggtttttgtgggagatttgggatttgtgatgggtttattgttttttggtaggtgggtgaggttagaaggttgtaggggttggagttggttgggttagttgggtaggattgagttttattaaaggttgtggggaatggtttgggggtgggtagttttaattaaagttgttgtgggggagtagttataagtttgagtttgttttgattttgttagtttatttataggttttttttttttaaggaggatagatatagtagaggggaaatgattttggggttttttggagggaagggtagttgaatttaagtttttatttgattttagtttttgtgtgattgatattattatatttgttttttggtttttggagggtgtgttttttttttaggataaaatttggagtttttttagtttattagtttttaggtaataattttattttttgggattatgtttttgataagttaggaaaagttagttatgattttgtatttttaagtttttggggtagggaagaggttttatttaagtgattaaaagtttaggggagtttttttggaataaggagtgggtttatattaaggggaaggttagtggttttgggggaggagtagggattttttttttttttatttgttttttgggtttagaatttaggattttgattttagtttggagtttttttttgtattttggttggtggtgtgttgggtgataggattttggaggggtattttgagtgtagttgttggaggaggtagggtggtggggggggtagtatagaagtttttaaggttttaggtgtagttttggattttgtggagttgtatggagtgaggagaggtgtggatgtttagaaatagatgtgggatgagggtattgggtagttatagggtttatgtggaggaggataggtagttaaggagggtttttggaggtggtgtggagggtttatttgatggttagaggaggttaggtagagttgttagtgttagtttggaggtggggttatttttgtgtaggtgtttgggggtggagagtaggtgtgatgggggttgggtatagtgggttgttttagagtattttgggtaggagtgataggtatttgttagtattttgagtagttatgttggttattattttggaagagattagtgtaggtgtagagggaggatgggagatttttgggggttttggagtttttagaatggttgaggagaggagggttgggtatattggtttttaggttgggtgtgtggggttgaggtgggtggtgggtgattattttttaggattgtggtttgtgtaatttggtggggggtaatgggttgttatttattgatttgggggagttgggttagtagtttttaggtgataggtaggagtttggttttggttgtggtgattttgagattttttaggggtttttaggtggatgtgtagtattggtagtgttggttggtaggtgggagggtttttttgatatgttttgatttgtggttgatagg

SEQ ID NO: 696 - DNA, 4394 bp, Artificial Sequence
  chemically treated genomic DNA (Homo sapiens)
tttgttaattatgggttggggtatattagggaggtttttttgtttgttggttgatgttgttaatgttgtatatttatttggaggtttttggggaattttagagttgttatagttaaaattaaatttttgtttgttatttggaaattgttggtttagtttttttaagttagtgaatggtaatttattgttttttgttaggttgtataggttatagttttaagaagtggttatttgttatttattttagttttatatatttaatttgggggttagtgtgtttaatttttttttttttagttattttggaggttttaaagtttttaagggttttttgttttttttttgtatttgtgttggttttttttaggatggtggttagtatggttgtttagggtgttggtgggtatttgttatttttgtttaaagtgttttgaggtagtttattgtatttagtttttattatatttgttttttatttttagatatttgtatgaaggtggttttatttttaggttggtattggtagttttgtttggttttttttggttattagatgggttttttatattatttttagaagttttttttgattatttgtttttttttatatggattttgtggttgtttagtgtttttattttatatttgtttttgggtatttgtatttttttttattttatgtggttttatgaggtttaggattgtatttggggttttagaggtttttgtgttgttttttttattgttttgttttttttgatagttgtatttagggtatttttttagagttttgttatttagtatattgttagttagggtgtaggagggagttttagattgagattggggttttgagttttaaatttaggaagtgagtaagagagagaggggtttttgttttttttttagggttattggttttttttttggtgtgaatttattttttgttttaaggaagtttttttgggtttttaattatttaaataaaattttttttttgttttagggatttgagagtataaggttatagttggttttttttggtttgttaggggtgtgattttggaagatgagattattgtttaagagttggtgggttggaagagttttaggttttgttttgggggagggatatgttttttagggattaggaagtaggtgtaatagtattagttgtataagagttggaattgggtgagggtttggatttagttatttttttttttaagaagttttaggattgttttttttttgttgtgtttgttttttttggagaggggaggtttgtggataggttggtaaggttaaggtaggtttaggtttgtggttatttttttataatgattttaattggggttatttgtttttgggttattttttatagtttttggtgaggtttagttttatttagttggtttagttagttttagtttttgtagttttttgattttatttatttgttaaaaggtagtggatttattgtagattttaggttttttataaaggtttagagtaagggtggggtaggtgtttaatgggatgggttagtatattttttttgggaatgtgggttgttttgtaagggttggggagggggttaagaaagtagattgtagtatggtttttttttgtttagttggttaggtatggttgggttttattttatttaggtttaattggtggttttatttggtataggggattggtttgaggagtgtgtgggttttattatagtataattttaggtttggggtgggtgagttgatttattttttatgttttttttttttttagggatatgggaatttttagggttttgaggggttttttagtttagggtttgtgataagagttgttggagtaaatttttaaagtttttagtttataggtggtaaaggggtttttaaggaaatggatttgtttagatttgggggttttgaggtttgatttaggtttttagtaataagggtgtttagtatagattttaattttatttgttttgaatgagtattatttttttttgttttgttttgtttttagggaggttgtggttagtttgtagtttttaaggtataatttagggtggtatatgggggagaggtatttggtgtttttgttttgggttttttgtatttttggagtttggtgttttgtaggtgggtggtttgtgtaggaggttgtgtagggtggtataggtgtattttagtgtggggggtgtaaggggtttgtgggggttataggggagtgtgaaagttattataggttttgggattttggtgttgtgatttttgtttgtttttgagttttggtttttgaggttttatttgatgagtgtggaggtgggtgtagttagtaggtagagggtgagtggtagaaggttggagggttgtatggtggtggtggttgggttggagagggttgttgaggttgtgtgtttatagttgggatgatgttgtagttgggttggattagttgatttgtgtgtttgtatttggattggttatgtgggtgtggttggtgtgtgtggggtggggtggagtggggtttggtttgggtggggtaattttggtgtatgtgtatagtgtttgggtggggggtggggtggtggtgtgtttgttgtgtttatagtttttgttgtttgtgtttgtggggttagtttggtttagtttttggggtttggaggatttttgttttggtttggtttggggttgtggggtggtttattttggagggttttgtggggtgatttttgttttggttgttgtggttgtttttgtgtttaggtttgtgtggggtgttgtgttgtgggtttttgtatttgttttttttggtgtttttttgtttttttttgagatgtttttagatattttttttggaagttttttgtaaattaaggttaaatttaaagtttttagtttattgaatggattttttgtttttttatagggtttttagagaaatttggaaaattagtttaggttttgttgtaaagggggttggatttgttttgttttttttttttgggtgttgtgtttagagatttaggttttattgatggttttagtttttagattttaaattttagttttatattggtatagttttatgtggtagatagtaggtttgaaggtaggtaaagtattttattttaaaatatattttttttatatgttttgatatggtattgtatagttgttttttgagggggtgaaatttgtgttttttagagaagtttttttttttaggaggttgggtattttttgtttatttatgttaatttttttttttttttttttttttttgagatagaattttgttttgtggtttaggttggagtgtagtggtatgattttggtttattgtaatttttattttttgggtttaagtgatttttttgttttagttttttaagtagttgggattataggtgtgtgttattatgtttggttaatatgtatatatatatatatgtatgtatatatatatatatatatatatatatatatagtgtatatatatatatatatatatgtatatatatatattatatatgtatatatatatatgtatatgtgtatatatgtgtatatatatatgtatatgtgtatatatgtgtatatatatatatgtatatgtgtatatatatatatgtatatgtgtatatatatatatgtatatgtgtatatatatatatgtatatgtgtatatatatatatgtatatgtgtatatatatatatatgtatatgtgtatatatgttttgtatttttagtagagatggtgttttattatgttggttaggttggttttgaatttttgattttaggtgatttgtttgttttagttttttaaagtgttgggattataggtgtgagtaattttattttaattttttaggtaaaatataatttttttaattatttgttaattaggaaatttttgaattttttatgatttggaagttgtttttgttaattttgtttttaggttgaattaatgtatattttatatatgttgatttatggttttggtttgtaatatttgtttttgtaaaatttgtaaaattaggttgggtatggtgattgttgtttataattttagtatatttggaggttaaggtgggagtattgtttgagttgaagagtttgagattagtttgggtaatatggtgagattttgtttttatagaaaagatttgaaaattttaaaaaaaagtataaagttaagttgttatttagttattttgtttatatatttttaggatttgttgaggtggttttataggttatagtttttatatttgtttagaataaatatttttaaatattttatagtgtttggtttttttttaataatattttttatatttagggtatttagatggattttattttt

SEQ ID NO: 697 - DNA, 4857 bp, Artificial Sequence
  chemically treated genomic DNA (Homo sapiens)
ttttatgatttttttttttttttaatttgttttagttatattgatattttttttgtttttagaattttattaggtttttattttaaggtttttgtattggttgtttttgttttttggaaaggttttttgtttatttgttttatttttttttttattgtatttagtttttgtttgaatgttatttgtttagggaattttttttggattatttatttaaaatagtttatattttatttgtatttagatattttttttagtttgttttgttttttttagtttgtttattttttttagatagtgaaagattagataatatatatttgttttttattgttaatataataaaaggtgggaattttgttttgtgttttgttgtgtttttagtttttggattagtgtttagtataaagtaggtttttggtagatgttaaaggaatgtgttgagttttttattttggttagtagttattttaggtattgtatttatattaaattgttttgtttagttagatgtattttaagatggggagataattttatttttagtattttattttatttaaaaaaaaaaaaaatttggttaggtgtagtggtttatgtttgtaattttagtattttggaaggataaggtaggtggattatttgaggttaggagtttgagattattttgattaatatggtgaaattttatttttattaaaaatataaaaattagttgggtgtgttggtgtgtttttgtaattttagttatttaggaggttgaggtaggagaattgtatgaatttaggaggtggagattgtagtggttgagattgtattattgtattttagtttgggtgatagagtgagattttgttttaataaataaataaataaataataaaaagaaagaaaaaatttattataagtttttttaaatttatagaaaaggagatagaatggtataatatgtttttatatattgattatttttatataattgatataattatttggttattttgtttttattttttatttaagtatttatttatttattatttttttgagatagggttttgttttgttgtttaggttggagtgtagtggtgtaattatagtttattgtagtttttagtttttaggtttaagtggtttttttattttagttttttaattatttaggattataagtatgggttattgtatttagttaattttattttatttttaattttttttggaaagatgagggttttttatgttttttaagttgattttgaatttttggttttaagtgatttttttgttttggttttttaaagtattggtgttataggtatgagttattttatttgattttttttaaaatattataaaataaatatagatattaaaatgaaaataaaagaaaaagaaaaaataaaataaaaatttttaaaataataataataaaaaatgtagatattaataatatttattattaaatattttagtaagtatttgtaaaaataaataaataaataaaaattagaattttatttaagtatatagttattgttgtaatagtgatatttatttttttggttgaagtgtttttttttttttttttttttttttttgtgagaaggagttttgttttgttgttaggttggagtgtagtggtatgattttggtttattgtaatttaatttttgttttttgggtttaagtgatttttttgttttagttttttaagtaatatatatatgttattatgtttggttaatttttgtatttttagtagagatggggttttattattaagtgttttaatgtaggtgtaatgtttggaatagttgttggttaaaatggagggtttaatatatttttttaatatttattaaggatttattttgtgttgggtattggtttaggagttgggggtatagtgggaagtaaagtaagggttaagtgttttaagtgtttaagagatgtatattttaggatgtatttttagataaggatattttttaaaatattagtattttttttgataaaattaataaaaattttgttagttaaataattagttatatttatatttattgttaaagtttttatttttattttatagtagtggagagtgattgttttgggttttatgttaggaagagagagaattgggatttgtatttaggtaatttggggatagagttgtgattataattttatgagttagggttgagttagtttttttattattagttggttgtgttttgggaagggaagtttgtggtggaggaggtttgtatgggaggagggggaggtgtttatgtatttggggttgatttgtttttttgtaaaatgtttgggaggagtttttggggttataaaattgttttttttttgaggttagaaggagagaagatgtgtagggattttgtgtataggagttgtttttgtgatatgggttatttgttgttgttgttgttgttgttgttgttttatatttgtgttttaggtaggggttgggttttgaatgtttgtgtttggaatagggtttaattgagggggttgggggttgttagaggatgagttggaggaatgtggtttagtttttagtattttttttaattaaataatagtaatttttgtgttttgtgtaatgttatgtggtgtagtatttggtatttagtagttaaggaaatattagtggagtaaaggtatttagttttatataatttagtgagtgtttttttttttttttttttttttttgatagagttttattttgttgtttaggttggagtgtagtggtgtgattttggtttattgtaatttttgttgtttgggtttaagtgatttttttgttttagttttttgggtagttgggattataggtgtttgttattgtgtttggttaatttttgtatttttagtggagattgggttttattttgttagttaggatggttttaattttttgattttagatgatttatttgttttggttttttaaattgttgggattataggtgtgagttattgtgtttggtttaagtgttttttttttaaatggagttttttgaagttttttttttgtaattttaaattaggtgatgggattttattaattttgttttgtagaggaaattagggtatagagaggttagataattggtttaaaattatatagttagtgtttgaatatgtaggatttgattttgtagtgttttttagtgttttttatgttgttgggtttttttttttgagaaatggggggataggatttttttttataaaaggtttaaagggaggttgattgagtggtgtagagttagtgttggagatttgggattgttttttaggattttttttttttattgaggtgatttttatttatttttttggaaaatgtggggggttttgggttgaggaatttgagaaggaattgagttagggtgggtggttatagggtgttggggttgtgatgaataatttggaaagtgtttgagattgtgggaggttgggaatgagtaatagttttgggatattttgaatgtgtagttggaaagggatgtttgggaaggtttggaggttggggattgggtttagggattgggttgtaattttggggtggagtttggggtggggagagagtgttggggaggagttagagggtggggttggaattttaaggaagagttatgggagaggttatagattgaggaagagttaggagtggggttagaattttgaggtggagttagagggtggggttataattttgaggtgtaattagagggtggagttataattttgggaggagttagaaggtgggattagatttttgaggggtaggattataattttggggaggagttagagggtggggttggaattttaaggaggggttaggggtggggttataagtttggggaggagttatggggttgggttaggattttaaggggttaaggggtgggggttatgattttggggaggagttatagggtggggttgaaattttaagaagggattggggtggagttatgattttaggggaaaattaggggtggggagagttaaagggtgaagttagaattttaaggaggagttagagggagggattaaagttttgaggaggagttaggggtggggttatggtattggggaggagttagggggtgggaagataaggttaggaagagttaaagggtggggttagaattttgatgatgagtttggagtggggttaaaatttagttggagagttggagggtggagatagaattttgtgggaaattagagtatttaataatagaaattttggagggttgatggggttgggtttagaatttgggaataaattagtgggttgggagaggttttggagttgggtagaattagggggagtgagtggagggatagttttattagggtattgggagtgatggtataatataaagattgatgtgggtggggtaaggttagaatgtttttagtagaattggagaggtgtaattgattgagggttggtgtggtgagaaagatttaataggagtaggaatagaatgtattgatagagagggtggggatatgattgttaggatatatgttttatgaggatagaatgaaaggaaaaatgggttaaggtaggattttgggaaaggatttgtgggtagggatagaatgtttagttagtggggtggaggtagaatgtggataatggatagattggaagtattgttggttggaatttagtagaatatggatatgaatttgaatggatggggtttggagatttggtgttggtattgggatatgtaggggtgagtgggggttttggagttaagtgtagttaattttttttttttttttttttttttttttagt

SEQ ID NO: 698 - DNA, 4857 bp, Artificial Sequence
  chemically treated genomic DNA (Homo sapiens)
gttgggggaaggagggagaggagaggagaggttaattatgtttagttttaagatttttgtttatttttgtatgttttaatattaatattaagtttttaggttttgtttatttagatttgtgtttatgttttgttgggttttggttggtggtatttttagtttgtttgttgtttatgttttatttttattttattaattgaatgttttatttttgtttataagtttttttttaaagttttgttttggtttgtttttttttttattttgtttttgtgaggtgtatattttgatagttgtatttttgttttttttattagtatgttttatttttgtttttattaggttttttttattgtattggtttttggttgattatgtttttttagttttgttggggatgttttagttttgttttatttgtgttgatttttatgttatattgttatttttagtgttttaatggaattatttttttatttattttttttggttttatttggttttagagttttttttggtttattaatttatttttaaattttaggtttggttttattagttttttggagtttttattgttagatattttagttttttgtgaagttttgtttttgttttttagttttttaattaggttttggttttgttttagatttattgttgaggttttagttttgttttttagttttttttgattttatttttttgttttttagtttttttttgatgttataattttgtttttagtttttttttgaggttttagtttttttttttagtttttttttgagattttaattttgttttttagttttttttgtttttagtttttttttgaggttataattttgttttagtttttttttgaggttttagttttattttgtagtttttttttgaggttgtaatttttgttttttggttttttgaggttttagtttagttttgtagtttttttttaagtttataattttgtttttagtttttttttgaggttttagttttgttttttagtttttttttgaggttataattttgttttttaagagtttagttttattttttagttttttttgaggttataattttgttttttggttatgttttgaggttataattttgttttttggttttgttttgaggttttagttttgtttttagtttttttttggtttgtaattttttttgtagtttttttttgaggttttagttttgttttttggtttttttttgatattttttttttgttttaggttttgttttgagattgtagtttagtttttaggtttggtttttgatttttgggtttttttggatatttttttttagttgtgtgtttggagtattttggagttgttatttatttttggttttttgtggttttgagtgttttttgggttatttattgtggttttaatattttgtggttatttgttttgatttagtttttttttgaattttttgatttagagttttttatattttttggggaagtaagtgagagttgttttagtgagagggaaaggttttgagggatagttttgggtttttagtattggttttgtgttgtttagttagtttttttttgggttttttgtaaaagggggttttgtttttttgttttttagagggggagatttagtagtgtggagagtgttggggggtgttgtagggttagattttgtgtatttaagtattggttgtgtgattttaggttagttatttaatttttttgtgttttagttttttttgtgaaatgaaattaataaagttttattgtttagtttgaaattgtaaggaagaggttttgaagaattttatttaaaaaaagaatatttgggttgggtgtggtggtttatgtttgtaattttagtagtttgggaggttgaggtaggtggattatttgaggttaggagattgagattattttggttaatagagtgaaatttggtttttattaaaaatatagaaattagttgggtgtgatggtaggtgtttgtaattttagttatttaggaggttgaggtaggagaattgtttgaatttgggtggtagaggttgtagtgagttgagattgtgttattgtattttagtttgggtgatagagtgagattttgttaaaaaaaaaaaaaaaaaaaaaaaagtatttattaaattatgtaaagttaaatgtttttgttttattaatatttttttagttattgagtgttaggtattgtgttgtgtggtgttgtataaagtatgagaattattattatttgattagggaggatgttgaggattgaattgtatttttttaatttattttttgataatttttaatttttttaattagattttgttttaggtgtaggtgtttgggatttagtttttatttgggatgtaggtgtggagtagtagtagtagtggtagtagtggtgggtgatttatgttgtgagggtagtttttgtgtgtggggtttttgtatgttttttttttttttggttttaggaaggaggtagttttgtggttttagggattttttttagatgttttgtgaaagagtgagttagttttagatgtgtgggtgtttttttttttttttgtatgaattttttttgttataaatttttttttttggggtgtggttggttggtggtgaaggggttggtttggttttgatttatggagttgtgattatagttttgtttttagattgtttgggtgtaaattttagttttttttttttttaatgtgggatttggggtaattgttttttattgttgtaaaatgaggataaaaattttgatggtaaatatgaatgtggttgattatttggttaataggatttttgttagttttgttaggagggatattggtattttggaaaatgtttttatttagagatgtattttgaaatatgtattttttaaatatttaaaatatttaatttttgttttgttttttgttgtgtttttagtttttggattagtgtttagtatgaagtaggtttttggtaaatgttaaaggaatgtgttgagttttttattttggttagtagttattttaggtattgtatttatattaaaatatttaatggtgaaattttgtttttattaaaaatataaaaattagttgggtgtagtggtgtgtgtgtgttatttaggaggttgaggtaggagaattgtttgaatttgggaggtggaggttgggttgtagtgagttgagattgtgttattgtattttagtttggtaatagaataagatttttttttatagaaaaaaaaaaaaaaaaaaaaaaagatattttagttaaaaaagtagatattattgttatgataatggttgtatgtttaggtgggattttggtttttgtttgtttgtttgtttttgtagatgtttattagagtatttagtggtgaatgttattgatgtttgtattttttgttgttgttgttttggggatttttgttttgtttttttttttttttttgtttttattttgatgtttgtatttattttataatattttagaagaggttagatgaggtggtttatgtttgtaatattaatgttttgggaagttaaggtaggaggattatttggggttaggagtttaagattagtttgggaaatataaagagtttttatttttttaaaagaaattaaaaataaaataaaattagttgggtgtagtggtttgtatttgtagttttaggtagttgggaggttaaggtgggaggattgtttgaatttgggaattggaagttgtagtgagttatgattgtattattgtattttaatttgggtaatagagtgagattttgttttaaaaaaataataaataaataaatatttgagtagaaaataaaggtaaaatagttaaatggttgtattaattatataaaggtaattagtatataagggtatattatgttattttgtttttttttttgtgggtttgaaaaggtttataataagttttttttttttttttattatttatttatttatttattgagatgaagttttattttgttatttaggttagagtgtagtggtgtaattttggttattgtaatttttgttttttgggtttatgtaatttttttgttttagttttttgagtaattgggattataggggtatgttagtatatttggttaatttttgtatttttagtagagatggggttttattatgttggttagggtggttttgaatttttgattttaggtgatttatttgttttgtttttttaaagtgttgggattataggtatgagttattgtatttggttaagttttttttttttttaagtaaaataaaatattaaagataaaattgtttttttgttttaggatgtatttaattaaatagagtaatttaatgtaggtgtaatgtttggaatagttgttggttgaaatggagggtttaatatatttttttaatatttattaaggatttattttgtgttgggtattggtttaggagttaggggtatagtaggatgtaaagtaaagtttttattttttgttgtgttgatagtggggagtagatatgtgttatttaattttttattgtttgagagggataagtaaattggagaaaataaagtaggttgaaggaagtatttgggtgtaaatgaggtgtgagttgttttaggtgggtgatttaggaggggttttttgagtaagtggtatttaagtagaggttgaatgtagtgagggaagaagtagggtagatgggtagggaatttttttaaggagtaggaataattagtgtaaaggttttgaggtggaagtttgatgagattttaggaatagaagagatgttagtgtggttggaatagattaggagaggaagagagttgtaggg

SEQ ID NO: 699 - DNA, 5425 bp, Artificial Sequence
  chemically treated genomic DNA (Homo sapiens)
tttgagtttgtggttttggtttaaggtgtttgtgggtatagtgtgaggaagaaatatggaaaagatagattttttttagattgaaaaggagattgtttaggggtgggaggaagataaatagaggttagtgggttttgaggttgattgtatgtgtgatttgtgtttttgaaatattattttggaaattgtaggatttttgggaggaatggttgtaggggatgttttagtagatgagataatagttattgttattttattttaaatttttgtgtttttagtgggatatagaagtagtaggttgtttattaatttaagtagttatattagtttgggtagtggaaataatttagttatattttttgggaatagaggattaaatggatgtgttgtttttttttttaatttattatatgggattgtgtatagttttggtgttaggaattaattttaggaaggatgaaggttgatttttttagtttttagtagataagttgttaggggtagttattaatatataataattgagttatttatgtaaaataatggatatgtgatgttttttgtatgtttgagtttttgggttgagatttattttgttttgaatgttgtggtttttttaatgaagttgttgaggaatgtaggggttttgtttattttgtttttttttggaaattttgttttttaatttttagatttagagtagtgtttttgtttttagttttatattgtttatatttttattaggaaaagtaaataaaagttaaagttttgtttagttataagttttttttaaatggggtagttggattgtatatatttttggtgtattaattttatttagatagggaaaatatttttatattaaaagaaattaggttaaattatggtagagaatgtaaaatttatagtttaaaaatgatgaaattttagattttaaaggaattttttttttgtagggtagggggagggtattttgttttagaattttatgtgggtttttattggagtttttttgagaaggatatttttgtggaaaagtttgagtagttttggttttgtgtttggtttggttaggggttatttttttttggtttgggttgtagtgttttatgggtattgtgtttttgttaatatttttttatgtttttaaatttatagtttgttagtgtgggtgtaatttgagagttgttgtaggtttttagtttatttgttttttaaaggaggaaatggagaattagtgattttaaaggatttgtttggtgggtatttatgttttttaggttattgtttttttttgtgtttttggttatttttgttttttaattttgtaggaatttaggatttatgtgtaaatataaagaattgtatttatttatttttggtttttttttattttgtgtttttaattttgggggggttttttttttttattggggtatttgatgtttgtggggggtgtttagaaaagtttggtagattagtgattggtggttttggaataaatatattatagtttaaattgggggttggtggtggagaggtgggtggatgggggttataaatttgtttggtaattgtttttttagttaagagagaggagttgaggttttttggggttggaggattggaattggttagattgtgggtttaaggggtgaaggtaggttggtaggggtagtttttttttgttgtttataatttttgggtgggtgtgtagttgagttggtttggttggttggtgtaattttgtgtgttttttgtattgattaaaaatgggggttgaaatagtaaatgtgaggaggagtaattgttttgatttggtttagaagtgtgattaatggggatgtgagtttttttgtgtgaattaattagtgtagggtttgtgatagtatgggttaatggggtgttgatttggtgtaggaataaggtgggggtttggggttggttgtagatttttattgtagtggttaggaatgttagttgtttatgtgtttggttttttttggttgatttattgttttggttgttgtattatggatgtttttaggtaggtggttaattttgggtttggttttgttaagttgttgtatttagtaagtttttgtgagtgggtgttgggagtgaggtttaggtgggagtatgtatgtgggtgggtttgtatttttgtgtgtggtagttggatttttgttttttgttttgagttttttaggtgttttgtattagtgtgtatagtgggattagtagttttggtaagtgggttttgggaagaatgtagttggtgaggaagtttggtgaggtgtgtttgtgtagttgtttttggttttgattgttggtgtgaggtagtgtatgatttagttggttggggtttgttgttttgttggtgttatgtatttgtagatgtttgggttgtgttattttttgggttggtttgggggttggggtggggtgaaaaagaaaaagttttgatttttgtttttgttttgtgtagttgtgtggtgagtttgggtagtgtggagtggatgtatgaatggatatagtgtgaatgagtgatgaatgggaatgaattgatgataggttttgtatatgtagtggattatgttagttgaaagggattgtaaatttaaaggtttgtgtgtgtgtgtttttttatgttttatattagtgtttgttttagttagtatttaggaatattgttttttagaaatgtaaatttgaaaatttttagtttagtttttttttttttgttttttatagaatttatttttttttaaagtttttttttttattttttttttttttttaatttgtttgttttttaaaggtgtttgagtattttaattttggtagattttgggttgtttaatttaattttttgtttattttgttttggagtaaattgagtgattgaatttttttttgggttataattagattttgttggtggaatttattttttgtttttttaggttttagtttggtttttttttttttttgttaaatttattgtttttagttttatttgtagtgaagaaggtaaagtttttgatgtgttttgagtttattgttaggtggttgttgttgttgttagatttttatttttttaattaggatagagttgataatatgttggagtagtatgaggtatagttaagtattttataattattaattgttgagtagagtagaaatttttttgggatagagttttttttgtgttgtggtaagaatagagaatttaattttaaaggggaaaggattttttatttttttaggggtagtgtttatagtagttgagaggatagggtttatttttttttagtggttatagtttattttaggtgagattttttgttttagttgtggagatgttttttgtagtttttttttgtattttttatgttttggagtgtttttaatgtttgttttttatgtattttgttattaatttattattataattgtaatggtaattgttattagtaatataattatttgttattaatttttttgggaggatttttgtttttggattgtatgtaatttggggggtaggagggtgagggggtaggtagatgttgttttttatgtatttttttgatttagttgaattgtaaatattagagaagtttttaaattttttttgattgtaatttatagtgaaaaatatgtttataaaatgataaagtatatatatttaattgtaataaaaataaatgttttatgaaatgatgtgtagtttaattatttgtgatatatattattttgtattttattttgttttagtttgttttgttttattaaaaaaattagttgtgagttgggtgtggtggtgtatgtttgtaatttaagtaatttaggaggttaaggtgggaggattttttgagtttaggagtttgaggttgtagtgaattgtgattgttttattgtattttaggttgggtgatagagtaagattttgttttttaataaaaaaaaaaaaaaaaaaaaaaaaaaaattggttatgatttataaaagtaatgtattttttaattggaaaaaaaaaaatttattggattagggaggtgtgattttttagtaggagtttttaaaattgtttgtaattattttggttataaatttttatagaattatttttaatgaatgttgtttataagaaagatatagttttaggagtaagtttaaagattatttatagatgaatgtttttttttattaaaagaaaagatttattttattttatttgattagttggtgttaataagtatttaatattttagaaaataataatatatttttagatttagttgttaaggtagttttttttttaatttaatttttttttttttttttttttgagagaagttaagttttgttatgaggttggagtgtagttgtttggttttggtttattgaaatttttgttttttgggttttagtgatttttttgtttttgttttttgagtaattgggattataggtatttattattaagtttagttaatttttgtatttttagtagagatggggttttattatgttggttaagatggttttaattttttgattttatgatttgtttgttttggttttttaaagtgttgggattataggtgtgagttattatgtttggttttgtttaattttttattgttaaaatattgttttttgagataagttgtaatttagtttaggttatagttgtgttttaatgatgttttttttagtaagtattttaaaaaaaaaggtgttttttatttgtagattttttttggttggttgtttttgtatttattttgtgtttatttttaaagtttttttttttttttttattttttattaagggaatttttatatatataaagataaaagtagtgtaatgaatttttaaggatttatttttgagatttaataattattaatattgtgttagttttgttgtagtattttgggatgaattttatttatagtaggtttttttttttttttgtttattttatgttttttagtttagtattttagattaaaagagattggaaaattgagttatttgtataatttgggtataatttttttattgttgtttttttaatttagaattttatgtattttttattttagttttaggagagtggtgaatgagatttgtgaaggggatattttttagggaattggtaaatttgggtttttggaaaaagtgtattaatattagttatattgtttaattttatgtttattttgtgtgtaagttgtataattgttggttttgtggatatgggaaggaaggagattggttgtgggtggggatggaagtttggggattttattgtagatttttttttgtttttttgttaggtttgtatgtttagagggaaagtagtgtagaatatatttaaataattttatttttttttatttttttttagg

SEQ ID NO: 700 - DNA, 5425 bp, Artificial Sequence
  chemically treated genomic DNA (Homo sapiens)
tttagaaaaaaataaaggaaaatagggttatttaaatatgttttgtattgttttttttttgaatatataaatttgatgaggggataaggaagggtttatagtgaggtttttaggtttttatttttatttatagttagttttttttttttttatgtttataaagttagtgattatgtaatttatatataaggtaagtatgaaattaggtaatgtgattgatgttgatatattttttttaaaggtttgaatttattgattttttagaaaatgttttttttataaattttatttattatttttttaaagttaaagtaaagaatgtataaagttttgggttaaagggataatgataaaaaaattatgtttagattatataggtaatttaattttttgattttttttggtttaaggtgttagattgggaagtgtggggtgggtaggaagaaggaagagtttgttgtgaataagatttgttttagggtgttgtaataagattggtataatgttgataattgttgagttttagagatgggtttttggaggtttattatattatttttatttttgtgtatgtgaggatttttttaataaaaaataaagagaaaaagaaaagttttaaaaatgaatataaaataagtgtaaaagtaattagttagagaaggtttatagataggaggtatttttttttttaagatgtttgttaaggagggtattattaaaatatagttataatttaaattggattgtaatttgttttaaaaaatagtattttaataataaagaattagataaggttgggtgtggtggtttatgtttgtaattttagtattttgggaggttaaggtgggtagattatgaggttaagagattgagattattttggttaatatggtgaaattttgtttttattaaaaatataaaaattagttgggtttggtggtgggtgtttgtaattttagttatttaggaggtggaggtagaagaattgttggaatttgggaggtggaggttttagtgagttgagattaagtgattgtattttagttttgtgatagagtttgattttttttaaaaaaaaaaaaaaaaaagaattagattaaaaaaaagattgttttgatgattgggtttaagaatgtgttattgttttttgaaatgttggatgtttgttagtattagttgattaaataaaatagagtgaatttttttttttagtaaagagaaatatttatttgtgaataatttttgaatttgtttttgagattgtattttttttatagatagtatttattgaaaatagttttataaaagtttataattaaaataattataaatagttttaaagatttttattgaaaaattatatttttttaatttagtaggtttttttttttttagttgaagaatgtattgtttttgtggattataattaattttttttttttttttttttttttttttgttaagagatagggttttgttttattatttagtttggaatgtagtgggataattatagtttattatagttttaaatttttgggtttaagagatttttttattttagttttttgagttgtttggattataggtgtgtgttattatatttagtttatgattaatttttttaatgaaatagaatagattagagtaggatagaatataaaatagtgtatgttataggtaattaggttatatattattttataaggtatttatttttgttataattgaatgtgtatattttgttattttgtaaatatgttttttattgtaggttatagttaaaagaagtttgaaagtttttttaatatttataatttaattaaattaaggaaatatataaaaagtaatatttgtttgtttttttatttttttgttttttaggttatatgtagtttaagggtaaaaatttttttagaaaaattaataataaataattgtattattgatgataattgttattataattatagtaataaattaataatgaaatatatagggaataaatgttgggaatattttaaaatatggggggtgtaggaggaggttataggaaatatttttatagttggagtagggaattttgtttaaaatgaattgtaattattgagaaaaaataagttttgtttttttagttattgtgagtgttgtttttagaaaagtaagaagtttttttttttttaaaattggattttttgtttttattataatatagaggaggttttgttttagggagatttttattttgtttaataattgataattgtaaaatatttggttatgttttatgttgttttaatatattattagttttattttggttagaaaaataaaaatttaatggtggtggtagttgtttgataatgggtttaaggtatattggagattttgttttttttattgtgggtggggttggggatggtgggtttggtgggggaggggaggagttgggttggggtttgggaaggtagagagtgagttttattagtaagatttgattgtggtttgggagagaatttaattatttggtttattttagaatgaaatgaatagggaattgggttaagtagtttaaagtttattagagttagaatatttgaatgtttttaggggataagtaggttaaaaaaaggaggggggtggggagaaaggttttaggaaagggtaggttttatgggggataaggaggggaaagttggattgaaggtttttaaatttatatttttgaaaagtagtgtttttaagtgttggttaaagtaaatattggtgtaaggtgtaggggggtatgtatatgtggatttttaagtttgtaattttttttagttaatgtgatttattgtatatgtaaaatttgttattggtttatttttgtttattatttatttatattatgtttatttatgtatttgttttatattgtttgggtttgttgtatagttgtgtgaggtgaaggtagagattagagtttttttttttttgttttgttttagtttttggattggtttaggagatggtatagtttgggtgtttgtaggtgtgtggtattggtgggatagtaggttttggttagttgagttgtgtattgttttgtattagtagttagggttaggggtagttgtatgggtatgttttgttgagtttttttattaattgtattttttttgaagtttgtttgttggagttgttgattttgttgtgtatgttgatgtaaagtgtttaggggatttaaggtagggagtgggaatttgattgttatatgtagggatgtaaatttatttgtgtgtgtgtttttgtttgaattttatttttggtgtttgtttgtggggatttattgagtgtggtagtttggtgggattaggtttaaagttgattatttgtttgggggtgtttatggtgtggtggttagggtggtgagttagttaaggaggattgaatgtgtgaatggttggtgtttttggttgttgtggtgagagtttgtagttggttttgaatttttgttttgtttttgtgttgagttggtgttttattggtttgtgttgttgtaggttttgtgttaattggtttgtgtgaaggagtttatatttttattggttgtgtttttgagttgagttgaagtagttgtttttttttgtgtttattgttttaatttttatttttgattaatgtaaggagtgtgtgagattgtgttagttagttgagttggtttggttgtgtgtttgtttgaggattgtgggtggtgggaagaggttgtttttgttaatttgtttttgttttttgagtttgtaatttggttggttttagttttttaattttagaggattttagttttttttttttggttgaaagggtagttgttgagtagatttgtagtttttatttatttatttttttattattagtttttagtttgggttgtgatgtatttgttttagaattattagttattaatttattaaatttttttaagtattttttatgggtgttagatattttagtggagagagaggatttttttaaggttggaagtgtaggatgaagaagggttgggggtgggtggatatggttttttgtatttgtatgtgggttttgagtttttgtaggattaaagaatggaggtggttaaggatgtagggaggagtgatagtttgggaagtgtggatgtttgttaggtaagttttttaaagttgttgattttttatttttttttttgggaaatgagtgagttggaaatttgtgatagtttttaggttgtgtttgtgttgataagttgtgagtttagaaatgtgaggagatattaataagaatgtgatatttatagggtgttgtagtttaaattagaagaaggtggtttttagttaggttaggtgtagggttagagttgtttaaatttttttatagaagtgttttttttaaaagaattttagtggagatttgtatggggttttgaaatagaatattttttttttattttgtaagaaagaagtttttttgaagtttggaattttattatttttaaattgtgaattttgtattttttattataatttaatttagttttttttaatgtaaaaatattttttttgtttgagtaaaattgatgtgttaggaatatatatagtttaattgttttgtttagagaaggtttgtaattggataggattttggtttttgtttgttttttttaatgagaatgtgggtggtatggggttgagagtagaggtattgttttggatttgggaattggaggataaagtttttagaaaaaggtaaaatgaataaggtttttgtgttttttagtaattttattaagaaaattgtgatatttaagatagaataaattttagtttagaaatttaggtatgtaagaagtattatatatttattattttatgtaaataatttagttattatatattagtagttgtttttagtagtttatttattggagattaagggagttagtttttattttttttggagttagtttttaatattagggttatatatagttttatgtagtgggttgggagaagggatagtatatttatttggttttttgtttttaaaagatatggttgagttgtttttattgtttaagttgatgtggttgtttgggttgatgagtaatttattatttttgtattttattaggggtataggaatttggggtggggtggtggtggttattgttttatttgttaagatattttttgtagttattttttttgggggttttgtagtttttaagatggtattttagggatataagttatatatatagttagttttaggatttattgatttttgtttgttttttttttgtttttgggtaattttttttttagtttagagaaaatttgttttttttatgttttttttttatattgtgtttataaatattttaaattagagttataaatttaaa

SEQ ID NO: 701 - DNA, 8900 bp, Artificial Sequence
  chemically treated genomic DNA (Homo sapiens)
attataaaagtaatatatgtttgttgtagaaagtatagagaagtataatttatattatattaatagagattttttaagtataaaggtaggggtttttttaatttttgtattttgtttgttattttaaggagaattttaatagggatggagatttaaatataatttgtttgtatatatatagagtatttgtagaaatataagtaagaaattggaaatattgtttttgagtagaataattgaggaaatggggaagataagttaggtgttaaaggtattgatttttgtattatttatgtagttatattattaaaaaaattaaaaaatagtatgtaaattttaaaaatataataaatatttttataagaattttttaatatttataatttttatatagaaatgtgaaataaaaataaaatttattatgaaattataagttaaataaaaataatttaataagagtattttagaaatattgtttttatgtaattatttagataaaaaagaaataaaaggatgtaaagaaggtataaataaaagagaaagaatagaataaagaagagtgaaatgtttagatggaaagatttttaaaataagtttgttatattgaaaatatattgttagttggttgatatttaaatgtagaaatttttgaataatggtggtattaattattattaggaaggtttggtatggtggtttatgtttgtgattttagtatttttggaagttgaggtgggtggattatttgaggttaggggttaaattagtttggttaatatggtgaaatttttgtttttattaaaaatataaaaattagttaggtattatggtgtatatttgtagttttagttatttggaggttgaggtaggagaagtgtttgaatttgggaggtgtagattgtagtgagattgtgttattgtattttagtttgggagatagagtgagattttgttttttttatttgttttttaaaaaggagtattattaagaaaaggtgaatggttgggatgtatattggaaggaaataatggaaatttgaaaaggtgtaagaatttaaataaatttgtttattatagaaaataaattataaaataattttgtgttttttggtaagtttttttatgttaaataagaattgttttttgtattatatagattttttaaattttttgttgaagaggtttttggtagtttgtatttaagttagttttttatggaagtggtattgagtggagtagataaagataggaatttttgaagggttataatttttgtgtgtaaaaaagaagttatagtagtttgaagagttgtgtaggttttagggtgatattgggttgggaattttggagttaagtgttttatatttggtaagttatgatatatatattttttgtttaggtagaaattgagttttataaaagtgaaatgagaaaaaaaaaaaaattaaaaattaggtatgtatattgagaattatttagttttttttagaattgttttatattttttttatgtatttttattaaatttagatgtaaattaattttagaaaagtttaaataggtgtgtgttttatttttttgttttttaattaaatagtggtataagtttggaaatgttttatatttatttttggaaatttatagtttttgtttaggtaaatattaggtatttagttaattaaatgttttttgtttataggaaagtgttagtttttaggatgttatgtgtatggtttaataaaattatgtataaagtgatagtgtattttttttttatgggttgattttgttgttattattatttgaaaatggttttaaataaaaatgatttaagggttgaaataagataagattaaattgatgttatggtaaaaattgatgttatggtaattatattaagtattttttaattattggatggaattttttgttgattttagggtttagatgtaggtggaaatattttgttggtataaaagtaggtgaggattttattaattgtagttattgagaatttataagatgaagttaaaatttttttttggatttatagttaattgttttgaatatattttgtaaaaagtttagagaaaggtaatatgaatgaaataattttgggggattttaattgaggagtaaaatatttgagaatatgaggaagattttaaagtttttgtatatattttaataagaattgagataggtttttatttattttttttttagtatttatgattgaattagaaggaagtttgtaaaatttggttgtgattatagggtaagatgttatttaatagaagttagaaatttaatgttttttgttgagatgtttgagtgtttgttaggatttaaaaattttttttaagaattattgtatgttattggaaagatgtttttttgagtggtttttaggagttagatagagggtaagtagatattatgatattgttttattatttatttttaagtgatgtatagttatatttttaagttggtttatgataaagtggtttatttgtttagttgaatgattatagtttttgattattttttgaatagatgtttttatgtagatttgaatagtagtatggaattttttgaatgttgttgtttttattttttttttttaataaaatgttataaaaattaaagttggtagtatttttttagttattatttatgaatttgtaatgataagttatttgtttaagtttaattgattagttttaatgagtttttggaaatttttttgtagttaattttggttattttagtattagtattaattggtggttgattgggaaatagatattagaaaataaaagattttttttgtttttttttattagtgttgaagaataggttatgggtatgtgtgaagaattatgggttgatattatatgggttttttaggaatgtagaagtttttttttatttttgtagatattttgttttttaagttttttaattttttttttagttaaaagttagatattttgttttagaaaaggaattttttaaagtttttgaaaatattttttaaataattatttgatttaatattaatttaattatttataatattggttaattaaattgtatgtaatatattgttatatttttgaattatttaaaaaagataagagtggttattatttataaaaggtttgtggttttttatgttaattttaattttggtttttttaagtttattattttttttgtagtaagagttattgaaattttaagtgagttatattttttattattttttgttgaaaagggtagtgtgtgagaaaaatgttagaaaagtaattaattatgttttagagtagatttttagttgtagtgtatatttttttttaatgtgagatttaaatttatatgaaaatttaaagtaagagttgggtaatagaaatggttaatttagaaggtaatgtatgttttgtttaaaagtatattaaagtaatttatttttttaaagagaaaatttataggagtgaatttatattttttttgagaatagtatggtttatagtattaaattttatttttataggttgtgaattttagagtagtttgttattaatttttgatttttgtatattttggatttggtatataatgttatagtagtgttattgtaatgttgtataaagtagtttagtaattttttggtttattaggtttagagataatattgtagaaatgatttagtatttttaatattttgtggtttaaggtggggtatttaggggtagaattaataataatgttagaaattaaattagataagataattgaaatagtatgatttatgtgtgattttaagttataaaggaggatatggattaatggtatatttttaggttataggggtagtataagtggaaggatattattttagtattagattattttttgagtaattttggtaaattttttaaattttttaatgtgtagttttttaatatatgatataggtgtaaagaaaataaagtaagtgaatgtatgtgaaagttaatgttgattgggtatgggggtttatgtttgaaattttagtattttgggaggtagagttggggatattatttgagtttaggagttgaagattagtttgggtaatatagagaaattttgtttttataaataaaataaaataaaaaaataaatataaaaaattatttttaaattagttgggtttgttggtatatttttgttgttttagttatttgggaggttaagatgggaggattatttgagtttgggaagttgagattgtaatgagttgtgatagtggtattatattttagtttgatttatagagtgagattatgttttaaaaaaaaaaaaaaaaaaaaaaagaaagttaatgtttttttttttttttttgtttttttgttgttttttattgtagatagtttttatagtttgattagtttaaaatatttgaatttgttttttttttttttttttttttttttttttttttttttttttttttttttttttttttttttttttttttttttttttttttttttttttttttttttttttttttttttttttttttttttttttttttgtttttaagatggggttttttattgttttttaggttggagtatagtggtttgattttagtttattgtagttttatttatttaggttttagtgatttttttattttggtttttaagagatgggaagtaggaattgttaggttagttaagggatatatttattatttgtttagtgttattattgttatatttttgatttaagtagttaagggtttatgtagatgaaatggggtataaagataaaaatataaagatagatatattattgtttgatgtgggagtgataaggttatattgtaaataaatgtaggttgaggggtatttttgtggttatttttggaaagtataatttgttatagtagtaaatataggggtaatgaataaggggttttattttgtagtttttttgttttgtttttattattaaaaaaaaaaatttttttaaagtaagatgtttagataatatagtgagatgtttatttttttttttttttttttttttttttttttgagatggagtttttttgttgtttagggtagagtgtagtggtgtaattttggtttattgttgtttttattttttgagattttatttttaatttaaataaaaagaaagaaagtttttttgtggatgaagagatagatgtgtatataattggttagattgtggggtattatttaagaattataagttaagtgataagtgagtgtagtggagaaagatatttattttgtttttggggttgggtgaaaattttatagtgaatttggttgttgaatagttttttaaaagattttgaagtagatgaattgaaaagggagagaaagaaggttaagttgagaaaatttatgtttttttggatatatattattttgatgtggtgggtgatgggatataagggtatgttggtgtgtattgtaggttagtttgaggttgtgtgtatagggtttttgaagtttggaaaatatttatgtgaaatattaaaagaagttgagattagtaaatttgattttagattgagtatatttttgtaaaatagtataaattttagtagaatttaatttttttttttgatttttaatatttttttttgaattttaaaatagaaaaatttgagggtgattaggatgataaaaatatttattaaaatgtttttaaaattatttagaatttgaaggttattttgtttttatttggttaatgttatttttttttaaaatataggtaaagaaaggtaatagtttttgttatagtaatagtgatttttgttttatttttttaattttttttttattttattataaaggtaattttaaaatgtgtattgattttatgtttttatatttttaaattttattataaatgtttttttttgaattaattttgatatagttgtttattgtataatggttgaatttttataatatatgagttgtaatattaaggtataaatatgatattagtttaaaaaggaaattagttttaattttgaatatttttttatggttttgtgtatttttaaatttattgattttagaatttgtttatatttttaaaaattattgaagagtttaggttggttatggtggtttatgtttgtaattttagtattttgggaggttgaggtaggtggattatgaggttaggagtttgagattagtttggttaatatgttgaaattttgtttttattaaaaatataaaaaaaaaaaaaaattagttaagtgtggtggtatgtgtttgtagttttagttatttgggaggttgaggtaggagaattgtttgaatttaggaggtggaggttgtagtgagttaagattgtatgattgtattttattttggataatagagggagatttaattttaaaaaaataaaaaaaaaattattgaagagtttaaagagtttttatttatgagtttatatttattaatatttaatggtttagtgattatgttaaagtttaaaaatatttatttatttagaaaaatttattatatgttaatatatataatatatatttattttttaaaaatgataatttttaaaaaaaaattagtgatgagtggtattgttttatttttttgtaaaattttttattgtttggtttaatagaatatagttaaatttttatgtgtttttttatttaatttgttgtaaaattatatgttatgtagtttttagaaaatttttttgaatatttaagaggatgaagaggaaaaaaagataaataatattttagtattattatgaaaattattttaattttatagatttattgaaaatttttggggtttttagattatattttgagaattattgatttagaataatatttatttagtgttaattatgagtgaagataaatagaatttaaaattatttatatataaatatatatattaggtagaaataatgatataggtttgttttagtttttatatttatataatttgaatttttatataggttgagtattttttatttgaaatgttgaggatgaaaggtgttttagattttaattttttttggatattggaatatttgtatatatatagtgagatattttggggatgagatttatgtttaaatataaaatttatttgttttatatatatatagtttgaaggtaattttatatattattttaaatattttgtgtataaataaagtttttgttaagtatttatatgtggaaatttttatttgtgtaattatgttggtgtgtaaaatgttttagattgtgggttattttagattttagatgtttagaatagatatatttaatatgtgttataaatttagttttgttgtttgataaattatttttaagaagtattatgggttaatataaatatttagtagaaatttagttttattatgttagtttatatgaaaaataattataagttttgatttatatgtatttttaaattttattttgaatttttttaaaaaaatttttattttgaataattgtagatttagaggaagttgtaaaaaatgtatagagaagttttgtatattttttagtttgtttttttattgaaaattattttgtataattatagtataaggtgaatattagagaattgatattgttgttgtttatatagtttatttagatttaagatatatatatatatatataatattagtgttttgttatgtagttttattttatgtgtagattagtgtgattaatatttttattaatatgtggttgttttattattatagtttttttgtgttatttttttagagttatatttatttttatatattttttttttagtgttaattttttgaaattattaatttattttttatttttataattttgttatttttatagtgttatataaatggaattatatagtatttagtttgtatttagtataatttttttgagatttatttaagttgttgtgtgtattaatagtgtgtttatttttttgttgttggatagtattttatggtatggttatattattatttgtatgattatttattttttgatggatatttgaaatgtttttaatttttggttattttaaataaagtttttatgaatatttatatataagttttgtgtgaatatagtttttatttttttgagataaatgtttaaaagtgtaattgttggggtatatggtaagtatatgtttagttttattagaaattgttaaagtattttttagagtggttgtattattttgtatttttattagattagtaatgtttgagttatttggattttttgtatttatgttagtatttggtgttattttttattttagttattttgatagatatgtaatatgttattgtagttttaatttgtatttttttaatggttgataatgttgaatattttgtgtttattttttattaaatgattgtatattttatattttatatataagtttatatatatttttttaggtattatttagtttaagttttatgttttataaataaggatattgaggttttttaataggatgatagataatttaaaatttaaattttaaagaatttaaaaagagaattttttgtaattattattaaattaatttttatagttaatgtgagaaatgggaagatttagttatttattttttttttaaggagaattttttttaaaaaaaattatatggttttagtatatgttgggagttaaaagtagggaggttaagatattgatgattattattaatagtaatgttgaaattattggttgttgttatgattggtaagttaattttagattaattgttttttgtttttttttttttgttatgtttgtttgtagg

SEQ ID NO: 702 - DNA, 8900 bp, Artificial Sequence
  chemically treated genomic DNA (Homo sapiens)
tttgtagatagatatggtaaaaaaaaaaaaataaaaaatagttaatttaaaattggtttattagttataataataattagtagttttaatattattattaataatagttattagtgttttgatttttttgtttttagtttttaatatatattaaaattatgtaattttttttaaaaaaagttttttttaggaaagagatagataattgaatttttttattttttatattaattgtagaaattggtttaataataattataaaaaattttttttttaaattttttaaaatttaaattttaaattatttgttattttgttaagaagttttaatgtttttatttgtaaaatatggaatttaaattagataatatttaagaaaatatatataaatttatatatgagatataaaatatataattatttgatggaggataaatataaagtatttaatattattagttattaaggaaatgtaaattaaaattataatgatatattatatatttattagaatggttaaaataaaaaataatattaaatattggtatggatgtagagaatttagataatttaggtattgttggtttagtgggaatataaaatggtatagttattttgggaaatattttggtagtttttgataaaattaaatatgtatttattatatgttttaatagttgtatttttgggtatttattttagagaaatgaagattatgtttatataaaatttatatataaatatttatagaaattttgtttagagtagttaaaaattggaaatattttaaatgtttattagaaggtgaatggttatataaatgatggtatagttatattatggaatattgtttagtaataaaaaaatgaatatattattgatatatatagtagtttgaatggattttaagagaattgtgttgaatgtaggttgaatattatatgattttatttatataatattgtggaaataataaaattatagagatagagaatagattaatggttttaaagagttagtattgggaaagaagtgtatgagggtgagtatggttttaaagggatagtataagggagttgtggtgatgggatagttgtatgttgatagggatgttagttatattaatttatatatgggataaaattgtataatagagtattagtattatgtgtgtgtgtgtgtgttttaaatttgaataagttgtataggtggtagtaatgttagttttttagtatttattttgtattatagttatataagataatttttaatgagggaataagttgaaggatatataggatttttttgtatattttttgtaattttttttaaatttgtaattatttaaaataaaagtttttttaaaaaaatttagaatgaggtttaaaggtatatatgagttaaaatttatggttattttttatgtagattgatataatagggttgagtttttgttagatgtttatattaatttataatattttttaggaataatttattagatagtagaattaagtttataatatatgttgagtatatttattttgaatatttgaaatttgaaatggtttataatttgaaatattttgtgtattaatatgattatataagtggaaatttttatatataagtatttaatagaaattttgtttatgtataaaatatttaaaatagtatataaaattatttttaggttatgtgtatatgaaataaatgaattttatgtttagatatgggttttatttttaagatattttattatgtgtatgtaaatattttaatatttaaaaaaaattaaaatttaaaatattttttatttttagtattttagataaaggatatttaatttgtatagaaatttagattgtgtaagtatgaaggttaaaataaatttatgttattatttttatttaatatatatatttatatgtaagtaattttgagttttatttatttttatttataattaatattgaataaatattgttttaagttagtggtttttaaagtgtgatttgggaattttaaagatttttagtggatttgtggggttaaaatgatttttataataatattaaaatgttgtttgttttttttttttttttatttttttgggtgtttagagaaattttttagaggttatatgatatgtaattttataatagattgaatgaaaaagtatatgagaatttagttatgttttgttaggttagatgatgaagagttttgtaaaagggtaaaataatgttatttattattaatttttttttgaaaattgttatttttaaaaaataaatatatgttatatgtgttaatatatgatggatttttttaaatgaataaatatttttaaattttagtataattattaagttattaaatattaatggatataaatttatgaatagaagttttttgggttttttaataattttttttttgtttttttgagattgagtttttttttattgtttaggatggaatgtagttatgtagttttggtttattgtaatttttattttttgggtttaagtaatttttttgttttagttttttgaatagttgggattataggtatatgttattatgtttggttaatttttttttttttttgtatttttagtagagatggggttttagtatattggttaggttggttttaaatttttgattttgtgatttatttgttttggttttttaaagtgttgggattataggtgtgagttattatgattagtttgggttttttaataatttttaagagtgtaaataggttttgagattagtaagtttgagaatatataaagttataaggaaatgtttagaattaaaattagttttttttttaaattagtattatgtttgtgttttaatattgtagtttatatattatgaaaatttagttattatgtagtgaataattatattagaattaatttagagagaaatatttataataagatttgagaatgtgaaagtatgaagttaatgtgtattttagaattgtttttataataaagtgaaaagaagattgaaaaagtgaaataaaaattattattgttgtagtagaaattattatttttttttgtttgtattttgaaaagagatgatattaattaagtaaaaatagaatagtttttaaattttaggtgattttgaaagtattttaataaatatttttattattttaattatttttaggtttttttgttttaaaatttaaaagaaaatattaagaattagggggagaaattaaattttgttaggatttatgttattttgtaaaaatatgtttaatttaaagttagatttattaattttagttttttttggtattttatatgagtattttttgaattttaaaggttttgtatatataattttagattaatttgtaatatatattaatatatttttatattttattatttattatattaagataatatgtgtttaagaaaatatgagtttttttaatttggttttttttttttttttttttagtttatttattttagagttttttaaggagttgtttaatagttagatttattgtgaagtttttatttaattttaaagataaaataaatatttttttttattgtatttatttattatttggtttataatttttagatgatgttttatagtttaattagttatgtatatgtttatttttttatttataaagaaattttttttttttttatttaaattagaaatgggattttgagaggtggaagtggtagtgagttgagattgtgttattgtattttattttgggtaatagagagattttgttttaaaaagaaagaaagaaagaaaagaaaagaagtgggtattttattatgttgtttaggtattttattttaaaaggatttttttttttggtaataaaaatagagtagaggagttgtaaagtgaagttttttgtttattgtttttgtgtttattgttatggtagattgtattttttaaaaatggttataaaaatattttttagtttatatttatttgtagtgtgattttgttatttttatgttaaatagtggtatgtttgtttttgtatttttatttttgtattttattttatttatataggtttttgattgtttagattaggaatatagtagtagtgatattgggtaagtagtaggtatattttttaattgatttggtagtttttgttttttattttttagaagttgaggtgggaggattattggagtttgagtgaatgaggttgtagtgaattgggattgagttattgtattttagtttgggagatagtgagaaattttgttttgaaaataaaaaagagagagagagagagagaaagaaagaaaaagaaaagaagaggagaggagaggagaggggaagaggggaaaggagaggaaaagaaagaaagagagagagaaaagaaaaaagaaaagaaaagagagtaagtttaggtattttaaattgattaagttataaggattgtttgtagtggggaataataggggaatagggaaaggggaaaaagtattagttttttttttttttttttttttttttttgagatatggttttattttgtggattaggttggagtgtagtgttattattatggtttattatagttttaattttttaagtttaggtgatttttttattttagttttttgggtaattgggataataggagtgtgttagtaagtttggttaatttgggagtggttttttgtgtttgtttttttgttttgttttgtttgtagagatagggtttttttatgttgtttaggttgatttttaatttttgggtttaagtgatatttttggttttgttttttaaagtgttagaattttaggtgtgagtttttgtgtttagttagtattggtttttatatatatttatttgttttattttttttatatttgtgttatatattaaaaaattatatattagagaatttaaaagatttgttaaagttgtttagaaagtgatttgatgttaagatggtgtttttttatttgtattatttttatagtttagaagtatattattaatttatgtttttttttataatttggagttatatatggattatgttgttttagttattttgtttaatttgatttttaatattgttattgattttatttttaagtgttttattttaaattatagagtgttaaagatgttggattatttttataatgttatttttaagtttggtgaattaagaaattgttagattattttgtgtaatattataatggtattgttgtaatattatatgttaaatttagaatgtgtaaagattagaagttgatagtaaattattttaggatttataatttgtaaaaatgaagtttggtgttatgaattatgttgtttttaaaagaaatgtaagtttatttttgtaaattttttttttgagaaagtagattattttgatgtgtttttaagtaagatgtatattattttttaagttagttatttttgttatttagtttttattttgagtttttatgtaaatttgggttttatattaaaaagaaatgtatattgtaattgaaaatttgttttggaatataattaattgtttttttaatattttttttatatattattttttttagtaggaaatggtaaggaatatgatttatttaaaattttaatgatttttattgtaaaaaaaataataaatttaagaaaattaaagttgaaattaatatgaaaaattatgaattttttataaatgatgattatttttgttttttttaaataatttaagaatatagtaatgtattatatgtaatttggttgattaatattatgaataattgaattggtattaagttaagtaattatttaaaagatatttttagaaattttaaaagattttttttttaaagtaaaatatttgatttttgattgggaaaaagattgaagagtttaagaaataaaatatttatagagatgaaagggagtttttgtatttttaagggatttatatagtgttagtttatagttttttatatgtgtttatagtttattttttaatgttaataaggagggataaaaaaggttttttattttttagtgtttattttttaattagttattaattaatgttaatgttaagataattaaggttagttgtaaaaaagtttttagaaatttattggaattaattaattagatttgggtaagtgatttattattgtaaatttatgaataatagttagagaaatattattaattttgatttttgtagtattttattaaagaagaaaaatgaaaataatgatatttaagaaattttatgttattatttaagtttgtatgagaatatttatttaaaagataattagaagttatagttatttagttgaataagtgaattattttattatgggttagtttgaagatatagttatatattatttaaaaatggataataaaataatattataatgtttatttgttttttgtttggtttttggaagttatttaaaagaatgtttttttaatgatatatagtaatttttgaggaaaatttttagattttgataggtatttaagtattttagtaggagatattgggtttttggtttttgttagataatattttattttatgattatagttaaattttatagatttttttttaatttaattataagtgttgaaaagagaatgagtaaaagtttgttttagtttttattaaggtatatgtagagattttggaattttttttatatttttaaatattttattttttaattaaagttttttaaaattattttatttatattatttttttttgggttttttgtaggatgtgtttagggtggttgattgtggatttgaagagggattttagttttgttttatgagtttttagtaattgtagttaatgaagtttttatttgtttttatattagtagagtgtttttatttgtatttaagttttgggattaataggaaattttatttaatgattgaagggtatttggtgtaattattatgatgttaatttttattatgatgttaatttgattttattttgttttaatttttaggttatttttgtttggagttatttttaggtgatggtgatgataaggttagtttatgaaaagagagtatgttgttattttgtatgtaattttattgagttatatatataatattttgaaagttgatatttttttataaataagagatatttaattagttaagtatttgatatttatttaaataagagttatagatttttgaaaatagatatagagtatttttaggtttatattattatttaattaggaaatagaaaaataaaatatatatttatttagatttttttaaaattaatttgtatttgaatttaataaagatgtatgagaaaggtatgaggtaattttaagaaggattgaatggtttttaatatatgtgtttggtttttggttttttttttttttttattttatttttgtaaagtttagtttttgtttgaatagaaaatatgtatgttatggtttgttaggtgtgggatatttagttttaaggtttttaatttagtgttattttaaaatttgtatagttttttagattattgtggttttttttttgtatatagagattatgattttttaaaagtttttatttttatttattttgtttagtgttatttttgtaaggaattggtttagatatagattattaaggatttttttaataaagagtttagaagatttatgtgatgtaaaaagtaatttttgtttaatataaagaaatttgttaaagaatgtaaagttgttttgtgatttattttttgtgataaataaatttgtttaggtttttatatttttttagatttttgttgtttttttttagtatgtattttaattatttatttttttttagtgatgtttttttttgggggatgagtgggggagatggaattttgttttgttttttaagttggagtgtagtggtataattttattgtagtttatattttttgggtttaagtattttttttgttttagtttttgagtagttgggattataggtgtgtgttataatgtttggttaatttttgtatttttggtagagataggagttttattatgttggttaggttggtttaatttttgattttaagtgatttatttattttggtttttaaaagtgttgggattataggtatgagttattgtgttgggtttttttagtgatgattgatgttattattatttaagaatttttatatttaaatattaattaattggtagtatatttttaatgtagtagatttattttgaaaatttttttatttaggtattttatttttttttgttttatttttttttttttatttgtgttttttttatatttttttattttttttttatttgaatgattatatagaaataatgtttttaggatgtttttattaaattatttttgtttggtttatgattttatagtggattttatttttattttatatttttatataagaattatgaatattagggaatttttatgaaaatgtttattgtgtttttaaagtttatatattgttttttaatttttttagtgatgtggttatataaataatataaaagttagtgtttttaatatttgatttattttttttatttttttaattattttatttagaagtaatgtttttagttttttatttgtgtttttgtagatattttatgtatatataaataaattatatttaagtttttatttttgttgaaattttttttaaaataataaatagaatataaaaattagaggaatttttgtttttgtgtttagagaatttttgttggtatggtataaattatatttttttgtattttttataataaatatatattatttttataat

SEQ ID NO: 703 - DNA, 2972 bp, Artificial Sequence
  chemically treated genomic DNA (Homo sapiens)
ttatttattttagttttataaagtgttgggattatttgtgtgagttattgggtttggtttttttatgttttattgtattgtttgttttgaaaagtatttattatttttgattggtttattatttagtttaattaaaataagagtagtttatatattataattatagtattataatattttgtttttttgtgtgtttattattattagtgagttttgtatttttagatgatttttttttgtttattaatattttttttttttttagattgaaaaattttttttagtattttttgtgggatataggtttggtgttgatgaaattttgtagtttttgtttgtttgggaaggtttttattttttttttttgttggaaggatatttttgttagatatgttattttaggttaaaagtttttttttttttagtattttaaatatgttatgttatttttttttggtttgtaaggtttttattggaaaggtggttgttttatgttatgtattggagttttattgtatgttatttgtttttttttttttgttgtttttaggattttttttttatttttgattttttggagtttaattattagatgttttgaggttgttttttttgggttaaatttgtttggtgttttataaattttttgtataaaaaattagttaggtatggtggtgggtatttgtaattttagttatttgggaggttgaggtaggagaattgtttgaattttggaggtggaggttgtagtgagttgagattgtattattgtatttttatttgggtgatagagtaaaattttgttttaaaaaaaaaattatttgggtttggtggtgtttgtagttttagttatttgggaggtaggaggtttatttgatgttgagattgtagtgagttatgattttgttattgtattttggtttgggtaatagagtgagattttgtttaaagaaaaaataaaaataaaaaagtaatatattttaaataaaggattttttataatgtttttattagatttttaattagaaatatggaggttaggaagtagtggagaatgatgatttttaggtagttttggaggatgttgttataggttggggtaagggtttttaggttattaattgggagttttgggaatagttttgttgtaaataggaagttatggtttggttagagtttagaatgtgggttgagttgggatttatgtgatagttttgaggtttattgggagtagtttttggataggagaggttttatttaggaaattttgggtatggttgggaagtggggtatttggtgttgggtttgtatgtgtgtgtgattggtgtgtgtgagagagaatgtgtgttttgagtgttagtgtgagtttgtgtatgtgtgaatattgtttttgtgtgggtgattttttgtatgtgtaattgtgtttttgtaagtgtgaataagtggataagtgtttgggagtggataagagatttgtgtattattaggtgtgtgtatagtgtttgtgtatgttaagagtgtaaggtgaagtgaagggattaggtttatgatgttatttattattaggagttttaaggttttaggtaagtgttagtgatagataagggtgttgaaggttattttggagtgggtaggtgggggtagggaaagggtaaggttatgttttggaggaggggttgtgattatattagggtgtatgagtttagttgggaggtggatggttgggtttattgagattttggttattttagaagtttgtgtgggtttggggagtttggagtggggagagggggtgatttttttgattaggtttttttattattttattttgggtaagggtttggagtaggaagtagtggtaaggatttttggagtagtttatatttgttttggtttgattttgttattggtagtatagttaatatagtaggtttatttatagtagagggtgaaggttattattagttttttttataagggaagggttatgtgtttggtgtgttgagagtgttttgtttggttttttgtgtttggtggggtgggggtgttaggtgtgtttagaggagtttagttggtagtgaggtagttatggggttagaagtattggtgtttttggttatgatagtggttatttttttgtttttggtggatttgatgtattggtattaatgttgggttgtatgttatttgttaggttttttgttattgtttgggttgggtaattttgttgtatgtggatttttagaatatattatattgttttgattaggtgagggaggaggttttggagggtggtagaggttttgaggatgttttattattagtaaatatgggtggtgggttaaattataggttggattagaagttaggttgagaaggggaagtaggtttgggggatgttttggggaaggatatttatatatggtatgaaggattggattttttaaaggttaaggaagagtagggtaagggtttggaggtggagttggatttggtagtgggtatgtaagtttattgggtaatatatgttatggagtataaagttttttttgttgatattagaaggaaaggttttgggaatggaagatgagttagttttgagtgttgtttaaattatgaaattgaggatgaagggggtgtagtgatttggtttaaattttttgtattgtgggtttttgggttttattgtttattggtatggattattatttgggaatgggatgttaattggggttttttggtaattttggtgatttttgtaaggttatatttgggtgatgtatttaaattgagtttttttattatagaaggtgtgatttttatttttgttttaggattaggaggttgggttttttttttttatttgtttatttttggtagttttgggggttgtttaaggtttaaataggattaggatttgtagtttggggtgattttggtttgataagaggttttgattttttttttgtagt

SEQ ID NO: 704 - DNA, 2972 bp, Artificial Sequence
  chemically treated genomic DNA (Homo sapiens)
attgtagagggagggttagggttttttgttaagttaggattattttagattataggttttagttttatttgaattttggatgatttttggggttattaggagtgagtaggtggaaggaggagatttagttttttgattttggggtgggggtgggggttatattttttgtgatggaggaatttagtttggatgtgttatttaggtatgattttgtaagagttattaaaattgttgagaggttttagttagtattttatttttagatgatggtttatgttggtgagtagtgaggtttgaggatttatagtgtaaaaggtttgaattgggttattgtattttttttatttttgattttgtgatttaaatggtatttaggattaatttattttttatttttaaggtttttttttttggtgttagtagaagggattttgtattttataatatatgttgtttaatgggtttgtatgtttattgttaagtttagttttatttttaggtttttgttttatttttttttggtttttggaaaatttagttttttatgttatgtataaatgtttttttttaggatgttttttaaatttgttttttttttttagtttggtttttgatttagtttgtggtttaatttattatttatgtttgttggtggtggggtatttttaggatttttgttgttttttaggatttttttttttatttggttgaagtagtatggtgtgttttggaagtttatatgtagtaaggttgtttagtttgggtagtggtaggggatttggtgggtagtgtgtagtttagtgttggtgttggtgtattaggtttattaggagtaggaagatggttattattatggttaggggtattagtgtttttagttttatggttgttttattattaattgggtttttttggatatatttggtatttttattttattaggtatagaggattaggtaggatatttttggtatattgagtgtgtgattttttttttataaagggagttgatgatggtttttgttttttgttgtgagtgaatttgttgtgttgattgtgttgttagtggtagagttaggttagggtaggtatgggttgttttagaggtttttgttgttgttttttgttttaggtttttatttagggtagggtggtagaaaggtttggttggagaagttattttttttttttattttaagttttttaagtttatataggtttttgggataattagggttttagtggatttggttatttattttttagttaggtttatatattttaatgtagttataattttttttttagaatatgattttgttttttttttatttttatttgtttattttagagtgatttttagtatttttatttgttattggtatttatttggggttttagagtttttgatgatgagtggtattatgggtttggtttttttattttattttgtatttttgatatgtatagatgttatgtatatatttgatggtgtatagattttttgtttatttttagatatttgtttatttgtttatatttgtagggatatgattatatatgtagaaaattatttatataaagataatatttatatatatatagatttatattgatatttagggtatatatttttttttatatatattagttatatatatatatagatttggtattaagtattttattttttagttatgtttgaggttttttggatgggattttttttgtttagaggttgtttttggtgagttttaaagttgttatatggattttagtttagtttatattttgggttttggttgggttatgattttttgtttgtaatagggttgtttttagagtttttagttggtagtttgaaggtttttgttttagtttgtgatagtattttttagggttgtttgagggttgttattttttattgttttttggtttttatgtttttgattagaaatttggtggaaatattatggaggattttttatttaggatatgttgtttttttatttttattttttttttagatagggttttattttgttgtttgggttggagtgtagtggtaggattatggtttattgtaattttaatattaagtggattttttgttttttaagtagttgggattataggtattattgagtttaaataattttttttttgagatggagttttgttttgttgtttaggtgggagtgtaatgatgtgattttggtttattgtaatttttatttttagggtttaagtgatttttttgttttagttttttaagtagttgggattataggtgtttattattatgtttggttgattttttgtataagaagtttatagaatattaagtagatttaatttaaagaagatgattttaaggtatttgataattaaattttgaaaggttaaggataaagaaaggattttaaaagtagtaagagaaaagaaataaataatatgtagtagagttttaatatatgatatggggtagttatttttttagtggaaattttataggttaggggggagtggtatgatatatttaaagtgttgaaggaaaaaaaatttttagtttagaataatgtatttggtaaaaatatttttttaataggaaggagaaataaagatttttttagataaataaaagttgtgagattttattaatattagatttatattttataagaaatgttaaagggagttttttaatttgaaaaaaaaaaggatattaatgagtaagaagaaattatttaaaggtataaaatttattggtaatagtaagtatatagaaaaatagagtattataatattgtaattgtggtgtgtaaattatttttattttaattagattaaatgatgaattaattaaaaataataagtattttttaagatagatagtatagtaagatataaagaggttggatttggtggtttatgtaggtaattttagtattttgtaaggttgaggtgggtgg

SEQ ID NO: 705 - DNA, 6101 bp, Artificial Sequence
  chemically treated genomic DNA (Homo sapiens)
gttattgagttttagtttttatatttgtaaattggggatagtagtatggtttttatttaatgtgtttagtaaagttattgaaaggagatagaaatgtatttaaattttttggatttttattttattttttttggggattgttattatttttttatgtttgttttttttggtttgatgtttgttgttatttttttttttaggtgtttttttgtatggtttttttattttagggattttagagttatagtatatgtatattattatttaagtatgtttatttgttttttgttttattaggttgtttttaaggaatatgtggtttttggtatatatttggtataatattgtatatgatatttatttatttggttttgaatttgataaggaatttggtatgatgtttatttatttaggttaggtgttgagtagttttggaggtttaggggttagagggatgggaaaaggtgtttttttggggtgagtattagtttttgtaggagggttgaatgtgagaaagaataaagagagaaggaagtgaataagtatagtttaaatattgtttatttttattgagttttaagaatgttgtgattttgtttgttatgtaatttatttattaggttaggtagatatagaatttgggtgtgagtgatgataatgagttgatataatttttatatttttattattgagattttttttattaggaatgggttagggagtttataggtggtagtaattgttattataggttttatttttattagtttttggggtttgttttttttttattagaaaattttttatttgttaaaaaggaagttatttgttttgaattttaattttatttttaagaggttgggattattttattggagtttttgatgttgtgtgatttgtagtgattattgttttattattgttggttgaggtggttggggtttatttggttatttgggtagttgtttttttttttttttttttttttgtttttagatatgtagtatttttagagagaaggggttattttttggtaaagaatttgtttaatttgttatttatggtaggatttttgaagggtttataggaagtagtataaattgatattattttattaagttattagttttattttatttatgttttgttttttttttaggggtttttttgttaatagaattatagaggattagtttgaaagtgtagagatagtagttgaggtatagttaagagttttggttgtattaatgatttaagaagttattagaaagttagaagggatgatatgtagaggtttagtaattttagttaagttaattttattagtttttttagttgtttattgtgtgtatagtattttggtagggattagagttatgatagggaataagattagattatgtttttgaggagtttatttttgtttagggaaataggtgtggaaatataatggtggtaaagaggaaagaggataataggattgtatgaaggggatggaaagtgtttaggggaggaaatggttatatttgtgtgaggagtttggtgaggaaagattttaagagaaggttttgtttgtttgggtttggaaggatgtgtaggagttttttagggggtataggtatattttaggtataggtaaagatttgtaggtgtggtttgttgggatgaattttaagtattttggaatgaggatagttatagagataagggtaggagagaggtgatttaatagattttatgttaatggttttatttgagtttttgataagaatttagaatttttggattttttagtaatattgattgagttgtttatgatattttatagaatatgaatttaaaggaggttagtgagtggtgtgtgtgtgattttttgttaatttttaaggtggagaagttttttttaattgtaggtagagtataggtggttttgttattggttgtagttttagttttgtttttttttttagtatataaataatttaatagttttattgaattattgttgtgtagggtaggaaagttttatgtatatagtttagtaaagagtaatatagagttgaaaggaagatttagaggagagagataagtaaggaaagtagtgatggtttttattttagatttggttatggaaatttggttttttttggttgttagtttggtgtttttttatttgtgagtaattgtttaggttttttttttttgtttttttggatttggggtgttaattaggttttttttttttttatttgttttgaagattaaaaaagatgtttaggttgggtgtggtggtttatatttgtaattttagtattttgggaggttaaggtaagtggattgtttgaggttaggagtttaagattagtttggttaatatggtgaaattttgtttttattaaaaatataaaaattagttgggtatggtggtgtatgtttgtatttttagttatttgggaggttgaggtaggagaattgtttgaatttggtaggtggaggttgtagtgagttgagattatgttagtgtattttagtttgggtgatagagtgaggttgttttaaaaaaaaaaaaaaaaaaaaaagatgtttaaggagtagtagtttaagtgttggatgttataaatatatagaggttattgtagattttatgtagttttataaaggaataaataagtattttttttatttatttttagtggtaagaagggttttgggatagtattgattgaggatgatttatttgataatagtttggatttaaggaggataaggaaggaaagtagtgatggattttattttaaatttggttgtggaaatttggtttttttttattaaattagaatttggattttatatttttttttttatgttgtagtagaagaggatgaatttttttattggtgggattttgttattttagagtaggtagagagaagagttattttttattgtgggtagtggaggttttttatatgttatattttatttttattttaattttatttttattaagatttgggaattataatgataggaaaatagaaaatataaattttattttaatttttttatagaaaggttagaaatttagtgagttgtggtaatatattttttattttttgattttttaatattaattgatatggtttaaatttattttattttaaattagatttttttggagatagtttatttttaatatgttttttttaggtgataaatgagggttgttagtttagtatttgttataataaatgtgtgtaaaataattttatttttttagaattatgttaggaatatgaatttaatgtataaatgtataattttatgataagattgtatatattttttaaaatatatttttttaatgtttattttaatatttttattttaaataaatttgtttagtaggttatgttaaatgtttagggtagaggagtaagtaagattgtgagttagtgatgatagtaaaagtatttaggtaggattaaaatggagtaagaaaatattttttattttttagggtagaattttaaagagatatttatgggttttggttttgtagtggaggttatttaaaggataaatatgtttgtattttatttgtttgaagtttggatatagaggtattatttgtgttattttgtgtgtggtttgttatgttgtggggtggttattatagatttaggtagttgggtagataatattttagttttagatgatgttgatgtagtttaggagttagaaattgtagtgtagataatgttttttttaggttaatataattaagtgtaatagatgattggtttttttgttagtttttttattggaattaaaagtagtattattttattaaatagaggggagttggaaagaaattatatagtttgtttagtttagtttttgttttgatatggaattatgtgagtttagatatttatttagattattttttggggattaatgttgttgatatattaatttaatagtttgttttggtttgagaggttatgtaatttgtagaaagtttagaagtagagattagtgttatttatttgttatggttgtgataataaaggaaggaataggagtgggaaaatttaaggttattttggttttggtagatggtgtatatgtttttattaattgttttggggtaaagatttaaatgtattattgggtttggttatgttgtttttgttgggttttttaaatatgagtttttatgttattttttagttgtattttattatatattattatagttattggatttgtatagaatatttggaatttatattgttttaagggttattttttaaagaagagaaaataaggttttaatttaattgtttggaatattttatgtttatttatgtggaatattatattttttgttataaataggagggaatgtggatatttgaaggtttttattttttagttaaaagtttatatgaagtatatggatttatttatatatattatgttttttagttatatttttttaatttgtttttttggggttaattttgtgggattagtagatttatggttgagttgaaggatggtgattttttttattagttttttttttttttttagttttttaatttttagtaatattagattgggaaggtttttagatatttagaaattttagtttggggagtttatatatgatttattaaagatgagttgtaagtaggtttgttttagggagtattagttttaatgggtttttttatagagatagttgatgggtagatgtaataaattgattgttttgtgattgattattttgagaaaaattagtatgtttggttatgttagtttttttttgtattgttataaagaaatattagagtttgggtatttataaagaaaagggatttaattgttttatggttttgtaggttgtatagaaagtatagtgatttttttttttagggaggttttaggaaatttataattatggtagaaggtgaaggagaagtagatagattttatatggttggagtagaagtaagagaggttggggagaaggtgttatatatttaaattattagattttataaaaatttattgttatgaggataatatttaaggtgggatggtgtgaaatgatgagaaattgtttttaggatttaattattttttattaggttttatttttagtattggggattgtattttaatatgagattttggtaggggtatagatttagattatattattggtattgtgttaattagatgaatattattagttggaaggttagattttataagaggaggaatgatttggaaattggttttttagttgtgatttttttgtatattgttatttagggaaatatgagttaattattttttttaataggttaaattaattagattatttgattatagagattgaggtgtagttgaaagttgtttatatttttatgaggttaatggaagttttgagtatagttgttaatttgtagaaataaggattttgtgatttttttaagatttttttgtgaatgatggtttaagaagaattagattttaaaatagggttagagtttagagggaagggaaagtataaaagtttttgagtaaattttaaagatagggttattataggtttttagtgattttttgtgattgagtggttgtagtgatgtaaaattttattattattgtggaagataaaaaaatgttattttttttatttaggatgagaatttttaaatttggggagaggttatttattaaatagatgtaaaggaataaagtgatttggaagaatttttgtttgaattttttaggattatttatatttgagaatatttattaaatatttattttaggattgggattatgaagattttagttgttttgagttaattattgtaattttttggtgttttatggtggaggtaggaaaggatttgatgaataaatataattattgttgttagagttattgttattattttttgttttaatgttattttgtttttttgagtattttagttttttagttaatgatttattaatttttatatttataaagttataattgttgtgatttgatttttgttttattttgtaga

SEQ ID NO: 706 - DNA, 6101 bp, Artificial Sequence
  chemically treated genomic DNA (Homo sapiens)
tttataaagtgaaatagaaattaagttatagtgattgtgattttatagatataggggttgatgagttattgattgaggaattggaatgtttaagagaatgaggtaatattaaggtaagaaataataatagtaattttgatggtaatgattatatttgtttattaggtttttttttgtttttattatgagatattaaaaagttataatgattagtttaaagtagttgaagtttttatggttttagttttggaatgaatatttgataaatgtttttaaatgtgaatgattttgagaggtttaggtaggaatttttttaggttattttgtttttttatgtttatttagtaagtggtttttttttaaatttggggatttttattttaggtagaaagggtgatatttttttgttttttgtagtgatgatgagattttgtattattgtagttatttagttatagagggttattgagagtttatggtgattttgtttttagaatttgtttagaggtttttatgtttttttttttttttaagttttgattttgttttaggatttggttttttttaaattgttatttatagagaggttttggaggagttatagagtttttatttttatagattgataattgtgtttaaggtttttattgattttatagaaatgtgagtagtttttagttatattttagtttttgtgattagatgatttggttgatttgatttattgggaaggatgattgatttatatttttttgaatgatagtgtgtagaagaattataattaaagaattaatttttaggttatttttttttttgtggaatttagttttttaattggtgatatttatttgattagtatagtgttagtgatatggtttgaatttgtgtttttattaaaattttatgttgaaatgtaatttttaatattggaggtggggtttggtaggagatgattggattttaggggtagttttttattgttttatattattttgttttaggtgttgtttttgtgataatgagtttttatgagatttggtggtttgaatgtgtggtattttttttttagttttttttgtttttgttttagttatgtaagatttgtttgttttttttttattttttgttatgattgtaaattttttgagatttttttagaggaagaagttattatgttttttgtatagtttgtagaattatgagataattaaattttttttttttataaatatttagattttggtatttttttataataatgtaagaaaagattaatatagttagatatgttaattttttttaaggtggttaattataaagtagttagtttattgtatttgtttattaattatttttgtaggaaaatttattaaggttggtgttttttaaggtaggtttgtttgtaatttatttttgatgggttatgtatgaattttttgaattggggtttttggatgtttgaagatttttttagtttgatgttattgagggttggaagattggaggaagaagaaaagttgatggaagaggttattattttttaatttaattatgaatttgttagttttataaggttggttttagagaggtaaattaggaaaatgtagttgaaaagtatggtgtgtataaatggatttatatgttttatatgggtttttagttaaaaggtaggggtttttgaatgtttatatttttttttgtttataataaaagatgtagtattttatataagtaaatataaaatgttttagatagttgaattaaaattttgtttttttttttttaaagggtagtttttaagatagtataggttttaaatattttgtataaatttggtgattgtgataatatgtggtaaaatataattgagaaatggtgtggaggtttatgtttgggggatttagtagaagtagtatagttaggtttaatagtgtatttggatttttgttttagaatagttagtggaagtgtgtgtattatttattaaaattagggtggttttgggtttttttatttttgtttttttttttgttgttatagttatggtaaataaatgatattaatttttgtttttaaattttttataagttatatgattttttaggttaggataaattattgagttaatgtgttagtagtattggtttttaaggaatgatttaggtgaatgtttagatttatatggttttgtgttaaggtagaggttaggttgggtaaattgtgtagtttttttttagtttttttttgtttggtagagtaatgttgtttttggttttaatgaagaggttaatagaaaagttagttatttattgtatttaattgtgttggtttaaggagggtattgtttgtattatagtttttgatttttgggttgtattagtattatttaaggttaaggtattgtttgtttagttgtttgagtttgtagtgattattttataatatggtagattatatatagagtgatatagatggtgtttttgtgtttaggttttaagtagatgagatgtaaatatgtttgttttttgagtgatttttattatggggttaggatttatgaatatttttttggagttttattttgagggatgaggaatatttttttattttattttgattttatttggatgtttttgttgttattattggtttatagttttgtttatttttttgttttgagtgtttaatataatttgttaagtaggtttgtttgaaataggggtattaaaatgaatgttgggaaggtatattttaaaagatatatgtaattttgttatagagttatatatttgtgtattagatttatatttttgatatgattttggaaaggtgaggttattttatatatatttattgtaataaatattgaattaatagtttttatttgttatttagaaggaatatgttggaaatagattatttttaaaaaaatttggtttaaaatagaatgaatttaagttatattaattagtgttaaaaggttagaagatggaaaatatgttgttataatttattgaatttttaatttttttgtgaaagaattaaaatgaggtttatattttttatttttttgttattatgatttttaaattttagtaagagtgaaattgaggtagaagtgaaatgtgatatgtgagaagtttttattatttatagtggggagtgatttttttttttatttgttttaggatggtaggattttattagtgagaggatttatttttttttattgtaatataaaggggaaaatgtaaaatttaaattttagtttagtaaggagaagttaggtttttatagttaagtttggaatgagatttgttattattttttttttttattttttttgggtttaaattattgttaagtagattatttttaattaatgttattttaaaattttttttgttattaaagatggatggggaagatgtttatttatttttttatagagttgtataagatttataataatttttatatgtttgtagtatttaatatttaagttattgttttttgaatattttttttttttttttttttttttgagatagttttattttgttatttaggttgaagtgtattggtatgattttagtttattgtaatttttgtttgttgggtttaagtaatttttttgttttagttttttaagtagttgggaatataggtgtgtattattatgtttagttaatttttgtatttttagtagagatagagttttattatgttagttaggttggttttgaatttttgattttaggtagtttatttgttttagttttttaaagtgttgggattataggtgtaagttattatgtttggtttgaatattttttttgatttttaaaatagataagggaaagagaggtttgattagtattttaagtttaaggaaatagagaagaggagtttggatagttatttatagatagaggagtattaggttgatagttaggagaagttaggtttttatggttaagtttgggatgagagttattattattttttttatttattttttttttttgagttttttttttagttttgtgttgttttttgttgggttatgtgtatggagtttttttgttttgtatagtagtgatttagtgaggttgttggattgtttatatgttagagaaggaggtagggttggagttgtagttagtagtagggttatttgtgttttgtttgtagttggaagaggtttttttattttggaagttggtaaagaattatatatatattatttattgattttttttgagtttatattttatgaggtattataaataatttaattaatgttattggggagtttaagggttttgggtttttattagaaatttaagtggagttattggtataaaatttattaaattgttttttttttgtttttgtttttatggttgtttttattttaaaatatttgaaatttattttaataagttatatttatagatttttatttatgtttggagtgtgtttgtgttttttagaagatttttatatatttttttaaatttagatagatagagtttttttttagagtttttttttattaaattttttatatagatgtaattatttttttttttgggtattttttattttttttatgtaattttattgtttttttttttttttattattattgtgtttttatgtttgtttttttgaatagaggtgagttttttaagggtatagtttagttttattttttgttatggttttggtttttattagggtgttgtatatatagtgggtaattagaaaggttggtggagttgatttagttgagattgttgggtttttgtatgttattttttttgattttttggtgattttttaggttattaatatagttagagtttttggttgtgttttagttgttgtttttgtatttttaggttggttttttgtgattttgttggtaaggggatttttaaaggagagatagggtatggatgagatggagttgatggtttggtggaatagtattaatttgtgttgttttttgtgaattttttaaaggttttgttatagatagtaagttagataggttttttgttaaagagtggttttttttttttggaaatattgtatgtttggaaataggagagaaaggagagaagagaatagttgtttagatagttagatggattttaattattttagttagtaatgatggggtagtggttattgtaggttatatagtattaaggattttaataagatggttttagttttttgggggtggaattggagtttaaagtaaatggttttttttttgataagtggaggattttttaatgggaggagggtaggttttaggagttggtagagatgaggtttgtaatagtagttgttgttatttgtgagttttttgatttatttttgatgggagagattttagtgatgagggtgtgaaaattatattagtttattattgttatttatatttaagttttgtgtttgtttggtttgatgaatggattgtatgataaataaaattatagtgtttttaaaatttaatagaaataggtgatgtttaagttgtgtttgtttgtttttttttttttttatttttttttatatttagtttttttgtagaaattgatatttattttagaaagatatttttttttatttttttggtttttaagtttttagggttgtttggtatttggtttgagtgggtgaatattatgttagattttttgttagatttaaggttaagtgggtgaatgttatgtgtagtgttgtgttaggtgtgtgttgggagttatatgttttttggggatagtttagtgaagtaggagataaataaatatgtttggatggtggtatgtatgtgttgtaattttggaatttttgggataaaagagttgtatagagaggtatttaaggaaagaagtgatagtaagtattaaattaaaaaggataaatatgggaaggtggtgataatttttaagagaggtaggataaaagtttagggaatttagatatatttttgtttttttttagtggttttgttgagtatattaagtaggggttatgttattatttttagtttatagatgtagaaattgaggtttagtgat

SEQ ID NO: 707 - DNA, 2425 bp, Artificial Sequence
  chemically treated genomic DNA (Homo sapiens)
  unsure (289, 833, 1773, 2369, 2374, 2386): unknown base
agaaggtatttatttaggtttggtatagtggtttatatttgtaattttagtattttgggaggttgaggtgggtggattatttgaggttaggagtttaagattagtttgtttaatatggtgaaattttatttttattaaaaatataaaaattggttaggtgtagtggtttatgtttgtaaatttagtattttgggaggttaaggggggtggattatgaggttaggagttggagattattttggttaatatagtgaaattttatttttattaaaaatataaaaaaattagnttgggtatggttgtgggtgtatgtagttttagttatttaggaggttgaggttggagaatggtgtgaattttggaagaagaggttgtagtgagtttagattgtgttattgtattttagtttgggtgatagagtgagattttgttttaaaagaaaaaaaaaaaaaattagttaggtatgtagtattagttatagtgtgtttgtaattttagttatttgggaggttgaggtaggagaattatttgaatttgggaggtagaggttgtagtgagttgagattatgttattgtattttagtttgggtgattgagtgagattgtgttttaaaaaaagaaggtatgtatttaaattataaggttaaaagagataaagtatgtgagtaaaataaagtaagttagttagtgtgggttgttttttttttttagtgaaggagttttttgttagaggtttttggatttgtttaatttgtatttggaaaggttattatttgtaggatttttatagttatatttggtatattttgtgattattattattatttttgttngttattatttatgattatgattatataatgggttttttttttttttttttttttttttttgagttattgtatttggtttgtatgtttttaatttttataattttaatgtaaatattagttgttttgaattttttagtttgtgttatataagtatagatttaaaaatattgtgtaattttagattaaggtttagaattttgttttttaattttttgtgggtttatggatttttttttttttttttttttttttttttgagattaagttttggtttattgtttaattttttaggttggagtataaatggtatgattttgggttattgtaatttttattttttgggtttaagtgatttttttgttttagtttttttagtagttgggattatagaggtatattattatgtttggttaatttttgtatttttagtagaaatggggttttattatgttggttaggttggttttgaatttttgattttgtgatttgttaaaagtgttaggattataggtgtgagttgttatgtttggtagggtttatggatattattagtatagttaggattttaattttttttattttgaaaattaggttaataaaaatttttaggagaaggtaaaatatattatggtgtttaagtattggggatttggtatgtattaggtgttttgtatgtttataggagtgttttagatggtttttaagttttttttttggaattttaatttaataaatgagttaattttgttttagttttttagtttttttttgtaatttatttatttttgtagatattttgttttaaggaattttgtttgggaaatttatattagatatatttattatggtgtttatagttgtatgggtgtgtgtttttttgtttatatggttagagttttgttttgttttgtttttttaaatttggtgggtggattgaggntggggttttatattaggttttattttgattagttatgtttattgttttgatttttaggtttttttagtttttgggtgtatgtgttggattttttttatgagggggtgggttgtggttaaattttttgttaggttagtggttgggtgttgattggttttatggtggtggggttggtttgtgattggttagtatgttgtggtttaaagtggttggtgtgggaattaggggtttattgtgggatggttttggagagtatttgggtttgtgaattttttggaggtgtaatgagttgtattaatttgtttattgtgttgtttggtttttttagtaagatttgggggtagatttaggtgtgggggttagttttgtgtgtggttggggatgaggtggttgtggtgatagtttgtgtttatgtatttgtgtagggtgggtttttaaatgattttatttttttttttaggtgatttttgggttgatgtttttaggaaaaaggtaatggttttgtggggttggggtggagttttttttttttttttggggattttttgttttgttttttttttttttttttttttttttttttttttttttttttnttttnttttattttttnttttttttttaagatgtattttttttttttttttttttt

SEQ ID NO: 708 - DNA, 2425 bp, Artificial Sequence
  chemically treated genomic DNA (Homo sapiens)
  unsure (40, 52, 57, 653, 1593, 2137): unknown base
gggagaaaggaagaagaaaggtgtattttagggaaagggnaaggggtagggnaaggngaaggggaggggaggggaggggagggaaggggaggggagggatgggataaggggtttttggagaagaggaaggagttttattttagttttgtgaagttattattttttttttgagaatattggtttgagaattatttagaggagagggtgaggttatttgagggtttgttttgtgtggatgtgtggatataggttattattatgattattttatttttagttatgtgtagggttggtttttgtatttggatttgtttttgggttttgttgggggagttaggtagtatagtgggtaggttaatgtagtttattgtgtttttgggaagtttatgaatttgagtattttttaaggttgttttgtagtaagtttttggtttttgtgttgattgttttaaattatggtgtgttggttaattatgagttggttttgttgttatggggttaattagtgtttggttgttgatttggtgggagatttggttgtagtttgtttttttgtgggaggaatttggtatgtgtgtttagggattgggagggtttggaaattagggtgatggatgtggttgattggggtggggtttggtatgaagttttgnttttggtttgtttattaagtttaaaggggtggagtgaggtggggttttggttatataaatagagggatgtatgtttatgtggttgtagatgttatgatggatgtgtttggtgtgggttttttaagtaaggttttttggaataagatgtttgtagaggtaggtggattgtagggagggattaaggggttggggtggagttagtttatttattagattggaattttaagaaggaagtttagaagttgtttagagtatttttgtgggtatgtagagtgtttagtgtgtgttaggtttttagtgtttgagtattatggtgtattttatttttttttaaggatttttgttaatttggtttttaggataaagaaaattgaagttttgattatgttaataatatttgtagattttgttaggtgtggtggtttatatttgtaattttagtatttttggtggattatgaggttaggagtttgagattagtttggttaatatggtgaaattttgtttttattaaaaatataaaaattagttgggtgtggtgatgtatttttgtaattttagttattggggaggttgagataggagaattgtttgaatttagaaggtggaggttgtagtgatttgagattatgttatttgtattttagtttggaaggttgggtgatagattaagatttagttttaaaaaaaaaaaaaaaaaaaaaaaaaaaaatttatagatttgtaggaggttaggggataaagttttggattttgatttgaggttatataatgtttttgggtttgtgtttatgtggtataggttgaaggatttagaatagttggtatttatattggggttgtgaaggttagaaatatataggttgggtgtggtggtttaaaaaaaaaaagaaagaaagaaaagaaatttattgtataattatgattataaataatagtnaataaagatggtggtagtgattatagagtgtgttaggtgtggttgtaaggattttataggtaataatttttttaggtatagattggatagatttaaggatttttgataaagagtttttttattgggaggaagaagtaatttatattgattggtttgttttattttatttgtatgttttattttttttaattttgtgatttggatatatgttttttttttttgagatatagttttgtttagttatttaggttggagtgtagtggtatgattttggtttattgtaatttttattttttgggtttaagtgatttttttgttttagttttttgagtggttgggattataggtatattgtagttggtattatatgtttggttaatttttttttttttttttttgagatagagttttgttttattgtttaggttggagtgtagtggtgtgatttgggtttattgtaatttttttttttagggtttatgttattttttggttttagttttttgagtagttgggattatatgtgtttgtaattatgtttggnttaatttttttgtatttttagtagagatggggttttattgtgttagttaggatggtttttaatttttgattttatgatttgttttttttggttttttaaagtgttgggtttataggtatgagttattgtgtttggttaatttttgtatttttaatagagatggggttttgttatgttggatagattggttttgaatttttggttttaagtgatttatttgttttggttttttaaagtgttgagattataggtgtgagttattgtgttgggtttggatagatatttttt

SEQ ID NO: 709 - DNA, 2359 bp, Artificial Sequence
  chemically treated genomic DNA (Homo sapiens)
ttttatttgtggtatgggtgtgtgtgtaaggttttgttgaatgtgattttttttgggaagtttttgttttgtggggtttgttgtgttatgtgggggtggggggaagtagattggttagggtttgatattaggagttatggttttgttttatttattgtattaattgtgatttgttttggagtttagttttgtagaggtttaaggagaggggtgggaaagtgttttttagagtagagtggtaggagttatggttggggttggtggaggttaggggttatatggggttggttttagaattgaggggttttgtggatttgttatatttttggtaaatggtgttgtgggtgttttgtttggtgggggtggtataaggtttttttttattttatttttgtagttggtatttgtggggttatttattttttgtatttttttagtttatttgttttattgtggttgtattatattttataaggtaagggttatattagttatgtttttggtgtttatttgaaaatattgtgtttttgtttgagggtattatttagtttggggaggtaggagggaggttggatatgaatgtgaatatgataggtttgtgagtagggtaggtagatatagtttggttgggtataaagtttattttttgagtatgagttgaggttgagggtgggtgggagtatatagaggatgtttttttagttgttagggtattagttttattattaagtattttaaaggggaattgtttggggttgggtgggttagtttgtagtagggattgagatagttattgtggtattaaagattagtagtgtagtatttatgtttagaggttggaatttattttgtgtattgttggtttggaaggtaggaattattttagtttagttgttttgtagtattattgggttagttatagagttatagatagatttgggtagttggaaaataggtttagagaaggggggtgtgggttgttatttgtagttattgtttggttttagagttgtgttatttgtgtaaagaagttagtgttaaggttgagtgtggtggtttatatttgtaatattaatattttgggaggttgaggtaggtggattatgaggttaagaatttgagattagtttggttaatatggtgaaaaattgtttattaaaaaaaaaaaaaaaaaaaaaaaaaaaattagttaggtatggtggtaggtatttgtaattttagttattttagaggttgaggtaggagaattgtttaaatttgggaagtggaggttatagtgagttaagattatgttattgtattttagtttgggtgatagagtaagattttattttgggaaaaaaaaaaaaaaaattagtgttaatggttgtttattattgattgttgaggtagttggtgataaattgatttaaaagagaggatttgttaggttgggtgtggtggtttatgtttgtaattttagtattttgggaggttgatgtaggaggattgtttgagtttaggagtttgagattagtttgggtaatattgtaaaattttgtttttattaaaaatataaaaattagttaggtatggtggtttatatttgtggttttatttatttaggaggttgaggtgggaggattgtttgagtttggtaggttaaggttgtagtgagttgtttgggtgataggatattgttttaaaaaataaagaaataaataataataataataataaaaatagaatttgttttttgtttattttgtgtggtgataggttagagggatttttgtatttaggtttattagttgttttttgttttgttgtatttttgttttataggtttggtagggttaaggtttttagttgttttgttggggtttttggtgtagggtggggtgggtggtagttttgtttttttttattttagattttttggttattttagttttttttattaagtaggattttgagattagagtttttagtaggggttttggagggattggtttatttgagtggagggttgtggtaggaataagtgtgggggttttaaagttttgttttaggtttagtggaattttgaagaggagggggagggtgagttgggtgtggttgtgttagttgagtgatagttatgggattgtgattaattttgtttggttttttagaggagtaggagggatgagtaagggttttttagtgtgataggttagtggtggggtgtttggggggagtgttgttttggagggttttggggatggtgatgtttgaagttttgtgtagaggtggggagatttttgagggttggtttttgaggttgggggggtttaggttttatgtgggggttgtgtttttaagttttattttttttagg

SEQ ID NO: 710 - DNA, 2359 bp, Artificial Sequence
  chemically treated genomic DNA (Homo sapiens)
tttaggggaaatggggtttgaaggtgtagtttttatatgggatttaggtttttttagttttgggaattagtttttagggatttttttatttttgtatggggttttagatgttattatttttgggattttttaagatagtattttttttaagtattttattattggtttgttgtgttgggagatttttgtttattttttttgtttttttaggaagttagatagagttggttgtggttttgtgattgttatttagttgatatagttgtgtttggtttatttttttttttttttttagggttttgttgggtttggggtggggttttgaggtttttgtatttgtttttgttgtgattttttatttgaatgggttagtttttttagggtttttgttgggagttttggttttaagattttgtttggtgggaaaagttgggatggttggagggtttgggatgagggggaatggggttgttatttattttgttttatattaggggttttggtagggtggttgagggttttggttttattaagtttgtggggtaggggtgtagtaggatagggaatagttagtgggtttgaatgtagaggtttttttgatttgttattatatagggtagataggaggtaagttttgtttttgttgttgttgttgttgtttgtttttttgttttttgagatagtgttttgttgtttaggtagtttattgtagttttgatttgttaggtttaagtgatttttttattttagttttttgagtaggtgggattataggtgtgggttattatgtttggttaatttttgtatttttagtggagatagggttttgtaatgttgtttaggttggttttgaatttttaagtttaagtgatttttttgtgttagttttttaaagtgttgggattataggtgtgagttattgtatttagtttagtaagtttttttttttgaattagtttgttattaattattttaatagttagtaatgggtagttattggtgttaatttttttttttttttttttaagatggggttttgttttgttgtttaggttggagtgtagtggtatgattttggtttattataatttttgttttttgggtttaagtaatttttttgttttggtttttggagtagttgggattataggtgtttgttattatgtttagttaattttttttttttttttttttttttttttagtagatggttttttattatgttggttaggttggttttaaatttttgattttgtgatttatttgttttggttttttaaagtgttggtattataggtgtgagttattgtgtttggttttggtattgatttttttatataagtgatatagttttaaggttagatagtaattgtaggtaatagtttatattttttttttttgggtttgttttttagttgtttagatttgtttgtagttttatgattgatttgatgatgttataaggtagttgggttgaggtggtttttattttttaggttaatagtgtataaaatgggttttagtttttgggtgtgggtattgtattgttggtttttgatgttatagtggttgttttagtttttgttgtaggttgatttatttaattttaaatagtttttttttggggtgtttggtaatgaggttgatgttttggtagttggggaggtattttttgtgtgtttttatttatttttggttttggtttatgtttaggggatgagttttgtgtttagttgggttgtatttatttgttttgtttataggtttgttatgtttatatttatgtttagttttttttttgtttttttagattgagtggtgtttttagatggaaatgtggtatttttagataaatattagaggtatgattgatgtggtttttgttttgtggagtgtgatgtagttgtggtgagataagtgagttgaaggaatgtggagggtgggtagttttataggtgttagttatagaagtggggtaggaagaagttttgtattatttttattaggtgaagtgtttataatgttatttgttaaaggtatggtaaatttgtaaggttttttggttttggggttagttttatgtggtttttggtttttattagttttagttatgatttttattgttttgttttgaaggatatttttttatttttttttttgggtttttgtgaggttaggttttaaggtaggttatagttggtgtggtgggtaagatagagttatggtttttggtgttaagttttggttagtttgtttttttttatttttatatgatatagtagattttataggatagaggttttttagaagaggttgtatttgatagggttttgtatatatatttatgttataggtggag

SEQ ID NO: 711 - DNA, 2474 bp, Artificial Sequence
  chemically treated genomic DNA (Homo sapiens)
tatgggtagttgggattataggtatatgttattatgtttggttaatttttgtattttttatagagatggggtttggttaatatgttggttaggttggttttgaatttttgatttagagtgatttgtttgttttggtattttaaagtgttgggattataggtgtgagttattatatttagttatttttgttatattttgatggatatatagaatagttttaatttaatgtgggaagatattatataagggtatgaattttaggtggtgaggattaatgggggttgtttttgaggttgtttattatagtatttttttattttttttgttttgtttgttttgttttttttatgtgtaggttttatttttaaataggttttttttagagagtgataaaggtgattattaatgtgtttagatttatatgttttgtgtttagtaattttagtgtaatttttttgtttttttaaaagttttggtaaaagttttaagttagtattttaattggtttaaattgtgtatatgtttatttttgaattaattattgtggattagagatgttatgttttgattgattagatttaggttatatttttagttttagttttgagggtagagttggtagtattagagtttatggaagaagtaagagaggagttgttgttaaaggaaaaattaaagtgttattattgaattaggatagatgttgggtagtatatgtgtattttgttttttttttatgttttagttgtatattttagtgttttttggtttagtattttttttattaaattatttgtttttttgttttattttttgtggttggtagaatgttaagatggttttaagatttttatttttggtgtttgtatattttttagttattttgttaaatatgaatgtagatgtttttgtgaaagaattttgtatatgtaatttaagttttaaattgtttgattttaaaataaggagaatggtagggttaggtatggtggtttatatttgtaattttagtattttgggaggttaaggtgggtagattatgaggttaggagattgaggttattttggttaatatagtgaaattttatttttattaaaaatataaaaaattagttgggtgtggtggtgggtgtttgtatttttagttatttaggaggttgaggtaggagaatggtgtgaatttgggaggtgtagtttgtagtgagttaagattgtgttattgtattttagtttgggtgatagagttagattttgttttaaaaaaaaaaaaaaaaaggagaatggttttggtgggtttgatttagttaggtgagtttttaaaaggtgatatatggtttggtgtagtggtttaggtttgtaattttagtattttgggaggttgaggtgggtggattatgaggttaggagattgagattattttggttaatatggtgaaattttgtttttattaaaaagataaaaaattagttgggtgtggtggtgggtttttgtagttttagttatttgggaggttgaggtaggagaatggtgtgaatttgggaggtggagtttgtagtgagtggagattgtgttattgtattttagtttgggtgatagagtgagattttgttttaaaaaaaaaaaaaaaaaaaaagaaaattaaaagtgggtattgttgtaagatgttgagtttatggtagtttgttatatgataatagaaaatgaatatattttatagtggattttaagatttttatgatttttgatttttttaattttttgatttttataggatttagagtataagaatgtttttttttttgtttttagttttattatttagaaaagagaggaggagtttagttttttattttatttttatttataaatttttaattttttggtttttaaggggtgattaaggaagttgttttatttggttttttataaatagtttgtgttttattaggtttaggagggtagtttgattaatttttatttttaagatttttggttagttttattgatttggatttttggataggtagttggattaatggatggatgttatgagggttttgttgtttttggggtttttgttggtgagtttggagttaatatttttggtgagtgttgtgggaattaggattgttttaggattgttttggggggttgttattatagttatgagttatggtttttgtttatgatttgtgggtttaggtgattaggaggtttatgtggaaaggtgaggttagtttggaaggtttaggtagaggagatagataattagattgggtggatataagggtatagtttgtatttttgggggagatgggttttaagaagataatggggggaggtagaaagggtttgggttttgggaagaaatttttgtatttttgggttgtgagaggaagttgtagattagtaatagattggtggtaggttatgatttatagttagttttttgttttttttttttttttgtaga

SEQ ID NO: 712 - DNA, 2474 bp, Artificial Sequence
  chemically treated genomic DNA (Homo sapiens)
tttataagggagagaagaaggtagggaattgattataagttatagtttgttattgatttgttgttagtttgtagtttttttttatagtttagaaatgtagagatttttttttaagatttaaattttttttatttttttttgttgtttttttaaggtttattttttttagaaatgtaggttgtgtttttgtatttatttagtttggttgtttgttttttttgtttgggttttttgggttggttttatttttttatataggttttttagttatttggatttataggttatgagtagaggttatggtttatggttgtgatagtgattttttagaataattttgggataattttggtttttatagtatttattgaaagtgttgattttaagtttattagtaggaattttaggagtagtagagtttttatggtatttgtttgttggtttagttgtttatttaggagtttagattaataggattggttaaaggttttggaaatagagattggttaagttgtttttttgagtttggtggggtataggttgtttgtggaaagttaagtggagtaatttttttggttattttttgagggttggaaagttgggagtttgtgggtgggggtgaaatgaagagttgggtttttttttttttttttagatagtgggattggaagtagaagaagggatatttttatgttttgggttttgtggagattaggaggttaaggagattaaagattatggggattttggagtttattgtgaagtgtgtttattttttattgttatgtaataaattattataaatttagtattttataataatatttatttttaattttttttttttttttttttttttttgagatggagttttgttttgttgtttaggttggagtgtagtggtgtaatttttgtttattgtaagttttgttttttgggtttatgttatttttttgttttagttttttgagtagttgggattataggagtttattattatgtttagttaattttttgtttttttagtagagatggggttttattatgttagttaggatggttttgattttttgattttgtgatttatttgttttggttttttaaagtgttgggattataggtttgagttattgtattgggttatgtgttgttttttaagaatttatttgattaggttaggtttattaaagttatttttttttttttttttttttttgagatagagtttggttttgttatttaggttggagtgtagtggtatgattttggtttattgtaagttatgttttttgggtttatgttatttttttgttttagttttttgggtagttgggaatataggtatttgttattatgtttagttaattttttgtatttttagtagagatggggttttattgtgttagttaggatggttttgattttttgattttgtgatttgtttgttttggttttttaaagtgttgggattataggtatgagttattatgtttggttttgttattttttttattttaaggttaaataatttgggatttaaattatatgtgtaaaatttttttatagaagtatttatatttatgtttgatagaataattgggaggtgtgtaaatattaggggtagagattttggggttattttagtattttattaattataggaagtgaggtaagaaagtaaatgatttaatgagaaaagtgttaaattaaggggtattaagatgtgtagttggaatatgagaagaagatggggtgtatatgtgttgtttagtatttgttttggtttggtaatgatattttgattttttttttagtaatgattttttttttattttttttatgggttttagtgttgttaattttatttttagagttagggttagagatgtggtttaggtttggttaattagagtatgatatttttaatttatagtgattggtttagagataagtatatatataatttaggttaattaaagtgttagtttgggatttttgttagaatttttgggaaagtaaaaaagttgtattggggttattaagtatagagtatgtgggtttgaatatattgatgattatttttgttattttttagggagggtttgtttgagaatgaagtttatatataggaaaagtaaagtaaatagggtaggaaggatggaaagatgttgtggtagatagttttaaagatagtttttattgatttttattatttaggatttatgtttttgtatggtgtttttttatattgagttagggttgttttgtgtgtttattagaatatgatagaagtggttgggtgtggtggtttatatttgtaattttagtattttgggatgttaaggtaggtagattattttaggttaggagtttaagattggtttggttaatgtgttggttaaattttatttttatgaaaaatataaaaattagttgggtgtagtggtgtgtgtttgtaattttagttatttgtg

SEQ ID NO: 713 - DNA, 6175 bp, Artificial Sequence
  chemically treated genomic DNA (Homo sapiens)
taaaatagaattgttggtttttgtaaaataataattatttattttataaaagtgataattaaaagattttaatagtaatatagaaagttatatgaatataaagatttaatttttttaaagtttagtttttttaagtaattaaaaatttgataaagataataagaatgaggaattattttgagaaaatgtaaaatttttttttttattttttgagatagggttttattttgttatttaggttaaagtgtagtggtataattatagtttattatagttttgaatttttggatttaagtgatttttttgttttagtttttttagtagttaagattataggtatgtattattatatttagttaattttttttagagatggggttttgttatattgttttggttggttttgaatgagttttaagtgagtgtgagttttttattttatttttttaaagtattaggattataggtatgagttattgttttttagtttaaaataattgttttttaggttagttattaaaaatgtaaagaaaaattttttgtagtgtgattgtttttttttatgggaagtttatttagataatttgtaagttaaatttgatgaaaataatatttgaatgtaattagatatagaaagattgtttaaggttatgagtagttgagtttaagtttgtattatttgttatataatagttaataagtttagagataaggtattgtggtaaggaaagttattttatttagagaattagaaaattaagaagatggtggattagtattataaagaattatttgaagttagtatgaatgttaggtttttttttatgttaagggaaggggaagaagaaggggattgggattaagaggtgattgatgattatagatatttgggtgttagtaagggtttgaggatgttgtaaaattttttttttttaggttaggttataatgtttttatatatttttaatataatattgttatttgtttgtatatttttttatttttttgggggttagtttggggaaaggaattgttattattttttttaaagttgaattgtaagttaaatttttataattagttggtttatgtatagagttaagtagaagtttttagtttaaaggataatatttttgggggttagaggtaaaatggagttagttatgttaagtttttttttatttttttttttttttgagatggaattttatttttattgtttaggttggagtgtagtggtatgattttagtttattgtaatttttgttttttgggtttaagtaatttttttgttttagttttttgagtagttgagattataggtgtttattattatatttagttaatttttgtagtttagtggagatggggttttattattgttggttaggttggtttggaatttttgattttaggtgatttatttattttggttttttaaagtgttgggataggtgtgagttattatgtttggtttttttatttttataattaaattagttgttgttttttttgttaagaaattagttatgaagatttatttatgttttagatgggaaaattgggttgtagtttgggagaggttagttagggataaagttaaagttaatatagagaatggagtttttagggtataggggttgggtttgggttagggagttggaaatttaggttttatgtttgttttagttttgatgttagttttgagtagtgttgttttttattagtttttgtttgttttaggggttatagggttaagttagatagagggttgttagtgttattggatataagattgtttttttatagttgttttttttttagtttttttgttttttatttggaaatttgggtattttttatttatttagttttgttttgtagtgagatttattgttgattgttttgttatttattttagggtaataaattagggtagagtagaattgtaattattttatgtatggagtgtataaaaggggaagggttaagggagttatagaattttagtggattttagagagagttttagattgagggaagtatggatggatggagaaggatgttttgttggggattgttgttgttgttttggggtttttgtatttttggttttttgatagatattattatttttaaatggtaattggtaatttaggtagagaaggggtgggaggggtgtagggtttttatttttttaatattttggtttttttatatgtggtgttatttagtttttatgattagttggatagggaagtatggatttgtttagagaggttaagtgatttgtttaataaatgatattagtagttaggtttagaagttgtgatttttgttttttgtttagagtattatgttaattaagtattgtagagaatttagaagtattaggatatgttttttgtatttgaggagtttatagtttgaatattaagaagggtatgggtggttgggtgtggtggtttttgtttgtaattttagtattttgggaggttgagatggattatttgaggttaggagtttgagattagtttggttaatatggggaaattttatttttattaaaaatataaaaattagttgggtatggtggtaggtatttgtaatttttagttatttgggaagttgaggtaggagaattgtttgagtttggaaggtggagattgttgagttaagattgtgttattgtattttagtttgagtgatagaataagattttattttaaaaaaaaaaaagatgggggttggggtatgggtatagttaattgtattagggaagtagtttgatattgtggttaaatgtaaggtttatagagttagattgtttttatttaaattttgttttattagtagaataaattaggtttggaattatgggtaagttatttaatttttttaagttttagtttattattttaaataggtatgataataatagtatttatttgatggggttgttttggggattttaggagataaggtatagaaagttgggtatgttgtaagagtttagttattgttagtattataggatagatttttataaatattaaaagtaaggtttggttgggagtagtggtttatgtttataattttaatattttgggaggttgaggggggtagattatttgaggttaggagtttaagattagtttgattaatatggagaaattttgtttttattaaaaatataaaattagttgggtgtggtggtatatgtttgtaattttagttatttgggaggttgaggtaggagaattgtttgaatttgggaggttgaggttgtagtgagttgatatagtgttattgtattttagtttggttaataagagtaaaatttagtttaaaaaaaaaaaagaaagaaaaaaataaggttttaggtagtttataattagaaggagaaaattttagtattttttaggtgttaggttttgtgggaataagtgatttattaagattgtagaaggaagttgggtatgtggtttatgtttgtaattttagtattttgagaggttgaggtgggtagattgtttgagtttatgagtttaagattagtttaggtaatatggtgaaattttgtttgtataaatataaaaattagttaggtgtggtggtgtaaatttgtagttttagttatttgggaggttgaggtgggagtattattttagtttgggaggtggaggttgtagtgagtagagattgatttattgtgttttagtttgggtgatagagttagattttatgtaaaaaaaaaaaaaaaaaaaaaaaagattgaagaaggggaagagatagtatttgagaaaaggttttatagagaaaggggtttttaatttggggatagtagatatgattagtagttttgaaggtagggaggtatattttaataatggtaatagttgttaagtttataaaatgtttagggtgttataggatttttttatatgttttattttaagttatgtttttaataatttagtatttttattttgtagatgaggatattgaggtttagggaggtgatatgtaagaggttaagttttaatatatattgggttttttgtttttgaaattgtttttttttgttttgaggtttttggagagtaattgttgggttgtgagtattgggtaagaggatgggtgttttaaagtagttgtattttaggataaaggtagaggaaagtaaaaatatttttttttgttgttatttaaaagagaaaaagaatggaattgggtaaggggtggagggggaatttagtttttgaaatagtattataggaattttgttatttgttatgtgtagagtattatgtgaggtatttgggatagttgaatgaatgagttttatttttaaggtgaatatgtatatatatatatttataatttatatttattgagtagtggttgtatggttttatttgtatagtgattttgaggtaggtattattattaggtttattgttagagaggggttaatggagatttagaagaggtttagagaggttaggtagtttttttagaattatataagtggtaaggggatttaggtatgttttttgtaattattgtttttattattgtatggtattagttttataagttgtatagtgtgggttgtgagatttaaggaaaaatagagttgaggtttatgggaaggtgaggttggtgtgggttggaggttttggggtaagttttttggaggtgggggtatatgttgggttttggaggattaaagaattggggggaaaaggaagggaagaaggaaaggattttttgaaaaggaaatggtaagaagtaaaggtttaaagtataggttgttgtgagtaaatagtgggaaatgtaatttttttggggttaaatttttgattttttatgtttttagttgtgaagtgggagtaataaaattatttattttatgagagtaaataaaataatgattgtgaaaatattttggtaatagtaatttgtgataggaagataataaattatttttgttataatattatgttgataggtataaaagttgtatttatgtttatgggtaaaatgggggtaagtagaatgtatgggatgtaagaaggatgtaggaaggaaagggtagtgtgagtataggaggattagttattgagaagaaagtagaagaaagagggaatttttgtgtgtatgggaaagtttattgtagagttaatttgggtttttattttgggatttttttgtgaatagttagagatatttttttttgggttttggtagtttttatgttgggatttaggggattttatatgggaaatagggttagatatatgttttgaatttttgttttaatatttttgagttatttttgtttttgtgagtttttattttttttatttataaaatggatgatagttagtttgttggtgtgattttagtagtggtttagtagagttagttttttaggtttttttaattttgttttttaaaggtgatgggaaaatatttagataagaagttaagggattgggatatatttttttaaggatgaggtgtatggtgttttgaagatgttggtatttttttaggtttaatttagtttagggggtttattttattatagttttggttgggtgtttgttttttggtattttggagattttgtagttgttgtgggtatttgttgttatttagtggttttttatggtattgtttttttgttagtttttagttttgataggggtattttttggtattaatttttttagagggaatgtttgtgtttgttttttgtttgtttttttgttaggtggagttttttaaaggtagttatgattattatttttttagttttagtgtttagtatagtgaggtataaagtagttgtttagtaggtgattatggaataaatgaatgaatggattaataaataaatagttttgtttaattaaaattaggtaatagaaggaagttattttagggttatttaatttttgggtagttgatttttttaaattgatttttgataagaagtaatttttataaatgttttagaggtttttagtgatagaggtgatttttaggtggttgggttaatgttaaaggtggttgtattaaaagtaggggtttggttttagggattttattattgtggtggaggtatagtatttttttatttttgttttttttattttgggttagg

SEQ ID NO: 714 - DNA, 6175 bp, Artificial Sequence
  chemically treated genomic DNA (Homo sapiens)
tttggtttagggtggaggaagtaaaaatagaaaagtgttgtatttttattatagtggtggagtttttgaggttaaatttttgtttttagtataattatttttaatgttagtttagttatttggaaattatttttgttgttgagggtttttggagtatttataagagttattttttgttaagagttaatttagaggagttagttgtttggggattaaataattttgaagtgatttttttttgttgtttaattttgattagataaggttatttgtttattggtttgtttatttatttattttgtaattatttgttgaataattattttgtgttttattgtgttggatattggagttagaaagataatgattatgattgtttttaaggaattttatttggtgggaggatagataggaaataggtatagatattttttttgaagagattaatgttagggagtgtttttgttaaaattaggggttggtggggagatagtgttatgggaggttgttaggtggtagtagatgtttatagtagttgtaaggtttttaggatattaggggataggtatttagttagggttgtggtggagtggattttttgagttgggttgggtttagagagatgttagtatttttagagtgttatgtattttgtttttggagagatgtgttttggttttttggttttttgtttagatgtttttttattatttttgagaggtagaattaaagagatttaggaaattgattttattgagttgttattgaaattatattaataagttagttgttatttattttatagatgagaaaaatgaaggtttatagggataaaggtgatttagaaatgttgaagtagggatttagagtatgtgtttggttttattttttatatagggttttttgggttttgatataaaggttgttaaagtttagaggaagatgtttttagttgtttatgggaaggttttaggatggaagtttaagttgattttgtaatagatttttttatatatataaagatttttttttttttttattttttttttagtggttagtttttttatatttatattatttttttttttttatattttttttgtgttttatgtattttatttatttttattttgtttatgaatatgaatgtaatttttatgtttattagtatggtattgtaatagaaatgatttgttatttttttattataggttattgttattaaaatatttttataattattattttatttgtttttataaggtggatgattttattatttttattttatagttgggaatgtggagggttagaggtttggttttaaagaggttgtattttttattgtttatttataatagtttatgttttggatttttattttttgttattttttttttagaaaattttttttttttttttttttttttttttttagttttttagttttttaaggtttaatatgtatttttatttttaggaagtttattttaaggtttttagtttatattggttttatttttttgtgggttttagttttgtttttttttgggttttatagtttatattgtatagtttgtggaattggtgttgtatggtggtgaagatagtggttgtagggggtatgtttgaatttttttattatttatgtgattttgagaaagttatttaatttttttgggttttttttaagtttttattaatttttttttaataatgggtttaatggtagtatttattttagagttattgtgtagatgaaattatgtgattattgtttaataaatgtaaattgtaggtgtgtatatgtatatgtttattttgagaatggagtttatttatttagttgttttaagtgttttgtatgatgttttgtatatagtgggtagtaaaatttttataatattgttttaaaagttggattttttttttattttttgtttaattttatttttttttttttttggataatagtaggggaagatgtttttatttttttttatttttattttggagtgtagttgttttgaagtatttatttttttatttagtgtttataatttagtaattattttttgagagttttagagtaagggaaagtagttttggaagtaaaaggtttagtgtgtgttgaggtttagttttttatatattatttttttgagttttagtgtttttatttgtaaagtgggaatgttgagttgttgggggtatgatttgagatgagatatgtgaaaagattttgtgatattttaagtattttataggtttagtaattattattattattaaagtgtgtttttttatttttaggattgttggttatatttgttgtttttagattgaaaatttttttttttgtgaggtttttttttaaatgttgttttttttttttttttagttttttttttttttttttttttttttatataaggtttggttttattatttaggttagagtatagtgggttagtttttgtttattgtagtttttattttttaggttgaagtgatgtttttattttagttttttgagtagttgggattatagatttgtattattatatttagttaatttttgtatttgtatagataaggttttattatgttgtttaggttggttttgaatttgtgagtttaagtgatttgtttattttagttttttaaagtgttggaattataagtatgagttgtgtgtttagtttttttttatagttttaatgaattatttgtttttataaggtttggtatttaggggatgttaaggttttttttttttaattgtgggttatttaaagttttgttttttttttttttttttttttttagattgagttttgtttttgttgattaggttggagtgtaatggtgttatgttggtttattgtaattttagttttttaggtttaagtgatttttttgttttagttttttaagtagttggaattataggtatgtgttattatgtttggttaattttgtatttttagtagagatagggtttttttatgttggttaggttggttttgaatttttgattttgggtgatttgttttttttggttttttaaagtgttgggattataggtgtgagttattgtttttggttaaattttgtttttgatatttgtaagaatttattttgtagtattaatagtagttgggtttttataatgtgtttagttttttatgttttattttttaaaatttttaaagtagttttattaagtaggtattgttattattatatttgtttaaaatgataaattgagatttggagaggttaaataatttgtttatgattttagatttagtttgttttgttagtgaagtaaaatttaaatgaaggtaatttaattttataagttttgtatttaattatgatattaagttgtttttttggtatagttaattgtatttatgttttgatttttgttttttttttttttgagatggagttttgttttgttatttaggttggagtgtagtggtatgattttggtttagtaatttttattttttgggtttaaatgatttttttgttttagttttttgagtagttggggattataagtgtttgttattatgtttggttaatttttgtatttttagtagagatggggtttttttatgttggttaggttggttttaaatttttgattttaagtgatttgttttagttttttaaagtgttgggattataggtaggagttattgtgtttaattatttatgttttttttaatatttaggttgtgagttttttaagtgtaaggggtatgttttaatatttttgagttttttatagtgtttagttagtatggtgttttgggtaggaagtaaaagttatagtttttagatttgattattagtgttatttattgggtaagttatttgatttttttgaataggtttatatttttttgtttagttgattgtaaggattgaatgatattgtatgtggaaaagttagggtgttgggaaggtgggaattttgtattttttttattttttttttgtttgagttattaattattgtttaaaggtggtggtgtttgttgggagattaaaggtataggagttttagagtagtagtagtagtttttagtgaggtatttttttttatttatttatgttttttttagtttggggttttttttgagatttattgaggttttgtggtttttttagtttttttttttttatatattttatgtatggggtgattgtaattttgttttgttttgatttattattttggggtagatggtagggtagttagtaataaattttattgtgggatagagttaggtgggtgaagggtatttaggtttttggatggggagtagaggggttggaggaaggatagttgtgggaaagtaattttgtgtttagtgatgttagtagttttttatttggtttggttttgtgatttttggagtaggtagaggttgatgagaaatagtattgtttagggttaatattaaaattgggataagtgtaaaatttaggtttttagttttttagtttagatttaatttttatattttggaagttttattttttatattaattttggttttgtttttgattggttttttttaggttatagtttagtttttttatttagaatatgggtgaatttttatgattggttttttggtaggaaaagtaatagttggtttaattataagagtagaggggttaggtatggtggtttatatttgttttagtattttgggaggttaaggtgggtagattatttgaggttaggagttttagattagtttgattaataatggtgaaattttatttttattaaattataaaaattagttgggtgtggtgatggatatttgtaattttagttatttaggaggttgaggtaagagaattgtttgaatttaggaggtggaggttgtagtgagttgagattatgttattgtattttggtttgggtaataagagtgaaattttattttaaaaaagaaagagagtggagggagatttagtatgattgattttattttgtttttgatttttaggggtattattttttaggttaaaagtttttgtttagttttgtatatagattagttaattataggagtttagtttgtagtttaattttaaaaaaaatggtaatagtttttttttttaaattaatttttaaggagataaggaaatatatagataaataataatgttatgttaaagatgtataggaatattgtgatttgatttagaaaaaagaagttttataatgtttttagatttttgttggtatttaggtgtttgtggttattagttattttttgattttaattttttttttttttttttttttttaatataaagaagagtttaatgtttatgttgattttagatggttttttatgatgttggtttattatttttttggttttttggttttttgaataaggtagttttttttgttataatattttgtttttagatttattggttgttgtgtggtaagtgatatgagtttggatttagttatttatagttttgaatagtttttttgtgtttgattatatttaagtattgtttttattaggtttgatttataggttatttaaatgggttttttataagaagaagtaattatattatagaaagtttttttttgtgtttttggtagttggtttaagaaataattattttaggttgggaaatagtggtttatgtttgtaattttagtgttttgggaggatgaggtaggaggtttatgtttatttgaagtttgtttaagattagttagggtaatatagtaagattttatttttgaaaaaaattagttgggtgtggtggtgtgtgtttgtagttttagttattggggaggttgaggtgggaggattatttgagtttaggagtttaaggttgtagtgagttatgattgtgttattgtattttagtttggatgatagagtgagattttgttttaaaaaataaaaggaaagattttatatttttttaagataattttttatttttgttatttttattaggtttttgattatttaggaaaattgagttttagaaaggttaagtttttatatttatgtaattttttgtattgttattaaagttttttaattattatttttgtgaaatgaataattattattttataaagattggtggttttgttttg

SEQ ID NO: 715 - DNA, 12610 bp, Artificial Sequence
  chemically treated genomic DNA (Homo sapiens)
tattaaatttggttaatttttaaattatttgtagaaatggagttttgtttgttgtttgggttggttttaaatttttgggtttaagtgttttttttgttttggttttttaaagtgttgagattataggtatgagttattgtgtttagttagataatttgattttttaaatttaaaaaaaatttagaaattttatattgaaatttaggtattagaattttagagattaaagttagagtaggtgtttaagggattgaaaggggttgtatggtttttgggaaatgtaattattggaaatgatattgtagtaatgtaatagtaatgtagtagtagtagtagttgtagtaataattgttatttatgaatgtttgttatgtgttaggttttgtgttaagagagttttgtaagtattattattgtatgaagtaggtattattatggttattttattgatgaggaaattgaggtgaatagattaaataattttatttaattttatatagaattattttagagtatgagttataaatatattttttttgttttggaaattaaattattaataaaaaatgtggtgtaaattggaaagaggatggttgtggtagattattataaagttaagtgggtaggtggttgttgggttagggtgggagaataaaggtagttgtaataaaaaaaaaaattaaaggtatataaagaaaaaggtttgttgagaataatttgtataaattgattttggttttagattttatttattttttttttattagttattttgtaattgtggagtatagtattttgagggttttttgtatataataattttttttatagtatataagataaaaagaagaattaggttgtaaagagagaagtattgaaggaaagaatattttaggttgaaagaagggtaagtttagggtgtatgtgaggaataaatgtatggatatggtgaagtgttatttttttatttttagtttaatataatttaattaaaaattattgggaggaggttatgttttgaattaaatttagtattttatatttttgaggtggtggaatgattgaggggagggggtttgtttagttatatttaaatttttttgagatagagggagattttttatttgttgtagtgtattttttttggttgtatttgatataggggttttgtgggttgaatagaaagggattttgttggaggggaggtattttgtatagaaggaaagtagggatatttggtagaagtaggtgttttgagaataaatagttaaagtagtttgtaatagttttaaaaagttattttttattgaatttggtgtgtttgttgttgtttgttttgtttttagggtttattggtttttagttttgatgttagatttgtagttttttatttattgggttagttaggatttgaggtggagtgtagaagtgagggtttggagatagttgagagttgtttttaaggagggttgggggtggggttagaggaggggttgggggtgggttttttgatgaaggggtggttatggtagttgtgtagaggtaatgtaggttgttatggagtgtgtgtttggttttgaatgagtggggttgggagtgagtgggtggagtgtgagtttgaggaagagataggtagtgtgtgtgagtgtgttttgtgtgtgtgtgtggtttgtggtagtttggagtttttgttgggtgggtggggagggggaggggtaggtgagtgtgtgtggtttgtgtgtgtttgggaggggtttttttttttttatttttattttgattttagttttagtttttggggtattgtttgttttttgttgttggttttttgtttagttgtgtattttttgtttttttattttttttttgtttttttattagattttttttgatgtttgatagttgttttgggtattgtttttgggttagggtgatttttggggtgaggaaattgtgattgggagtgggatttaggtgtgtagtatttgttatgttttgtttatgtgtgggagattgggttgtggggtattggtttggaaagtatgtagtttttaaagttgttttttttagggaaatttgtgtgattttattgttttttgtttataggttttgtatttttttaggttgatttttttataatttaaattttagtttatttggtatttagttttagtaatttagagtgttttatgttatgttgggtgttaggtgttggtttgtataatttgaaaatgtttttgttttttttatttgtgtagtgggtatgattttttttttattaataaattttatgtgggtaatttgaaatgaaattatttaagttatgaaattttttttttttgagttattttggagattttattttgtttttggaattgttttagtggtgttatatatttgagggtttgatttttggttgttagatatggtatagaatgtttgattttattattagtttttatattttgtttttgttttttttttttttatgggttgttgtttaaatttttatttattaaatttaagtgagtttaggtaaattttattttgggagttttgtaatattttttaatttattttagagagttatagtttgaggatattttggattgtattagattatatggtttttaaattttggtatgaaaagatttgtaaatagagttttagaaatatagtatttgtttagtatgtattgaatatagattttggttttgtttgttttgtgaattgtgatgtattgaggttatttgaaaggatttttagtagtttattgagaattttaataagaaaagatataatatatttgatttattagtttttaatgtagtattttttttttaattgtattttttttttgttaatatggtagagtttttatttttgattttttagagttgttatttttttaaaaagttttaatgaggatatattgttttatagttttgaattttattttgatatattttaaatttttgtttttgtaatttttaaggaaatttaatgttaagattagattatattaatattgttttgttttagaaagtgttttaaagtaattaaagtgtaaagtagtgtaagatatttattaaattggtgatttagagggtattttaaaaattgtattgaggtaatgtgtatataattaaaaggttttttaagtaggatatgatgtagggagagttttgggtttttgggttagtttttttaaattttgggtaagtgaatttaagtttgttaattttatttattaaatgggagtagtgaaaaatttattttttttggttgtttttaggattttagtgaggtgattgaatattgttttgagtgtttaagtgtttaaggaatgttagtttttttttatttaataaatatttgagtatttattatgtgtttggttttgattgagatttataaatattagaatgagtaagattgatggatgttttgtttttttagttttttgtattttttagggataagtttatgggtaagtttatgataattgggagtgaatgtagagtttttttatgtggagttggtagtattttttagtttttaaatttaaagtagtgattgaaatatagtaggtgttaatatatatttatttagatgaatagggatattaagtaaatataggttttaaaggatatttttgtttgttagttagtgtgattgataaaattaaagtgtggtttgattgtattttttttattttagtgtaattggttggaaaatttattttggaagtggtagtattattgaattattaagaatgttttttgtttatgagatgtttttggtttttgaattaaatatatttaggtttgaatggagttattggatgtgtttattttgtgtttaatttaatgaaataaggataatagtatttatgttataagatggttttttgagttgtgtgttaatattttgatagtgtatggtttatagtagatagttaatgagtattagttttttttttttattaattataaaaggaagttttttgtagaatgaggatatttttgattgttagggagagaattttattttgtaattattaaaagatttagtttttattttttattgggaaaaaaaaaataatttttaaattttatttttagttagtattgaagttatttaagttggtaaatatttataaaataatgatattaataatatttggaaaggtgatggttgtggttattagggtagtttatgaaatttatttttaatttttatttatgtatattttaaaattgatagttttaaatggtaaatattatttttttttataatatattgatagagtatttttttgattttatttttttttttgttaagtattatatgttttgtagttttttttttggttttttttttttataattttttagaaaatttaggttaatttttatttgagaaagtttttttttgattgagagttttgtttttgataaattagttttaaatgaagtgattgtttattattataattttttagattattttatttataatgaagtaattaaattttttttttaagttttattttgtaaatggtaattgaaggtattaaatgaataaaatattttagagaagggttgtatagggtaaagtaaggtatagaaataattataatataaaataaaaaatgttgttttttgggaagagtaaaatattagaattaagaagattttatagtattttagtaagaggtagtaaaggtttatgttagatagattatagtggaaataggaaagaatatgggtagtattgggaaattgaatagggtttttttggtaattaggtgtaaggagaaagaaaggaggagttagtattgttgtatgatttgaatttgagtaaattattggttgggatgtttttgatagaagtatttaaataatttgagtataatttttaatattttggttttttttttttttttttttttttttttttttttttaatagttattgttttttttattttgttaattagtaggttatttttaggttaggtatttagtaaattttttagtttatatggagagatagtttttatatgtataaaattatttgagtattgttaaggtaatattttagagttttgtttttgtattttaatagtttataagttttttttgattttagaaatagaaaagattagtgtgtgttttgtttttttttagaagaaattggtaatgatgtttttatagagtaattaagattagatattatgagagttaagtatgtttttttggttttttgattttgttttgtttttattttttatgtgtttgtttggaatttttgtattgaggtatagtatataaatagtatatatagttaagtatgtggtgttattatttagattgagatattagattttagttttttaatgttttagtatattttattagagatgattatttttttttattatataatttttaatttatttaatgtaatattttattaggtaaaaagttgttttttttaagattttaggagttttgaatttttatgaaatgtatttttaaaaagtatgggttgggtatggtagtttatatttgtaattttagtattttgggaggttgaggtaggtagattatttgaggttaggagtttgagattagtttagttaatatggtgaaattttgtttttagtaaaaatataaaaattagtgggtgtggtggtatgtgttagtagttttagatttgggggtggttgaggtatgagaatagtttgaatttaggagatagaggttgtagtgagttaagattgtattgttatattttagtttgggtgatatagtaagattttattttaattaaaaaaaaaaaaaaaaaaagtatgttatagtatagggatggtgtatttatttaggatgattttattttttatgtttttaaatgttattgtttattttatgtttatgtaaggtaattaaaaaattaattaatattttaattttaaaaaggtatatagttgtttttttaatgtggttatatgataattattatttaagttaggttttatttgtttttaagtaagtatgtgtagaattgaagtttaaatatattgtttgtgtttttttattttgggaaaaaaaattattaaattattgtatgttttttttttttgttttaagaagttagtattttaaataattgtattaattaagtgttgtgattgtttttaaaggtgttattaatggattgagaggttagtttgttttagttgtgattttgttattatttggttgttttattttgagtagaattgttaattttagtgtattttagtttttttatttagaaaatttaagaagttggatgatgtattttttagttgttttaatgataggaattatgattttgaatatatagtaattttttttttttgataaagagaaggtaaggaaaagttaagatatgagattttattattattaatgttatttttgtaagtgtgtgtatatatgtatatatatatgtatgtttgtttgtgtattttttgtgatttgatttaatatgtggtttgttttattttttaatagtggaaaaatgattatttttaatggattaatagattttttttttttttttgtgtgtattttgaggtttttagttgggatattgttatagttatttaagtttttaattttaatttgtgttaaaatttattttaagaaatttttaaaattaaatagtgattattagggtaaatatatgtagtatatatatagtatataatatatgtaatatatatatagtataggtgattaagatgtataagaaaaatttggaaattaagaattatgtttaaaaaggatatagattgggtgtggtggtttatatttgtaattttagtattttgggaggttgagggggtggattatttgaggttaagagtttgagattagtttggttaatatgttgaaattttgtttgtattaaaaatataaaaattaatttggtgtggtggtaggtatttgtggttttagttatttaggaggttgagataggagaattgtttgaatttgggaagtggaagttgtggtgagttgagattgtattatggtattttagtttgggtaatagagtgagattgtgttttaaaaaaaaaaaaaaaaaaaaaggttattaaaataatgttagttttattttttttttttttgaaatggagttttattgtgttgtttaggttggagtgtagttatgtgattttagtttattgtaatttttattttttaggtttaagtgattgttgtgttttagttttttgagtagttggaattataggtatgtgttattgtatttggttaatttttgtattattagtagatgtgggattttattatattggttaggttggttttgaatttttgattttgtgatttgtttgttttagttttttaaagtgttgggattatagatgtgagttattgtgtttagtatagttttattatttttagaatttttatttttattattgttatggttgtagtttttaatttttatattattttttttataaagatatatattttgttatttaattatagggaggtagtatgagtgtgatatttaaggattgagatattataattagattttttgggtttaaattttagttttataatttattagttttgtatttttggtagtttatttaattttgttgtgttttagtttttttatttgaagtagagataaaatagtatttgttttaagttttttttagggttgttgtgagtattgaatgagtattatatgttaattattaagaagaatgttttttatgaaatataaagtaagttattatagtatattgaaatgttattgtgaaattagatttttgtttttagagaagttttgaaataatgtttttttttattaattgttttagttttttaatggaagttggttttttagaaagtaataaataattgatataagattatgatggtgttaatgagtttttaaaatagtattttaattagaatatgaatattgttttaatttaagtgatataatattgtttaaaaatgtttttgtgtagattgttttaatagtttttttgagttttaattgaaatgtaataaattgtatataattaaagtatataatttgattagttttgatgaatatatatatatttatttatgaaattattataattgaagttgtaagtatatttattatttttaaaagttttgttatgtttgttagtgattttttttttttatttttttttgttttattataaggtattgttgatattttttgttattttatatttgtttataattttttgagtaattttgtttagtttgttgtttgtgggttttatatagtttaggatggttttgattgtagtttaatgtaaattagtaaatttttttaaaatattatgagatttttttgtaatttttttaggtttattagttttggttagtgttagtgtattttatgtgtggtttaagataattttttttttagtgtggtttagggaagttaaaagattggatatttttgttttagagtttaaaaaatattatatatggaattatatagtgtatatttttttggtggtttgattttttttatttagtataattattttgagatatagttatgttattatttgtaataatagtttatttttttttattgttgagtagtaagtagtttgttgtatttatatattataatttgtttgtttatttatttgttgatatatatttgtgttgtttttagtttggagttattaaataaaaataaagttgtaatttaaatataagttttttatttatttatttattttaattttttttttgagatggagttttgttttgttattaggttgaagtgtagtagtttaattttagtttattgtaatttttgtattttgtatttaagttatttttttgttttagtttttaaatataagtttttatatggttatatatttttttttattttgggtagattattaggagtagaatggttgggttatatggtagatgtttgttaaattttgtaagaaattattaaattgttttttaaagtggttgtatattttatttttttattattaaagtgtgagtgtgttagttgttttaaatttttattagtatttgttatggttattatgtttagtttgaattattttagtaggtatgtaataattttttattgtggttttaatttgtatttttttaatgattaaagatgttgattattatttaatttatttatttattattgtatatgtttttttttttttttttgagatggagttttattttgttgtttaggttggagtgtagtggtgtgattttggtttattttaagttttgttttttaggtttatgttatttttttgttttagttttttgagtagttgggattataggtgtttgtgattatgtttggttaattttttgtatttttagtagagatagggttttattgtgttggttaggatggttttgattttttgattttgtgatttgtttgttttggttttttaaagtgttgggattataggtgtgagttattatgtttggttttgtatatgttttttgatgaaatgtttagttagattttttgtttgtttttaaattgagtttttaaaaattatttttgaattttgagaggtttttatatattttgggtttaagttttttattagatatatgttttgtaaggattttttttttagtttgtgatttgtttttttattttattaatagtgtttttgaattgtagtttttaattttgataaaatttaatttattaattttttattttatggattgtgtttttgttgtattatttaaaaatttttgtttaatttagggttataaagttgtgttgttttttttttttgtaaattttgtagttttagattatatttaggtttataatttatttttaattatttttaattggtgttagatatatatagaaggtttttgttttgattttttttatatggatatggatatttagtttaattagtatttttttttttttaataattatttttttttttttgaattatttttgtatttttattagattttagtttttgtatatatgtgggtttatttttttattttttattgatttatttgtgtattttgattttaatattatatagttttgattattgaagttttataataagttttgaaattagatagtgttagttgttttattttgtttttttttaatgttgttttggttgttatatatgttttttgtatttttatatgaattttagaaattagtttgttaagttttaaagaaaaaatttgtttagattttggttgagattgtttggaatttataatttattttgggaaatgttgatattttaataaaaatattttgtttttgaaaaagtttttttaaattaataggttttttaattgttttagtaatatttgatagtttttagtagttaagtttttaattagatttgtttttaagtattatttttttatgtttatataaatttttttaatgttttaattttttattgattgttgttaatgtatagaaatataattaatggtagattttgttgaattttttatatagaatattatatttttatttttgtttttttattttggatgttttttattttttttttattttttttttttttttttttttttttttttttgttggattgtattggttagaatttttattatgatgttgattaaaagtagaaaaagtagatatgtttgtgttgtttatgattttagggagaaattattaaatttttttattattaagttttatattattgtaggttttttatagatgtttttgattaggttgagaaagtttttttatattttgttgtaatttttttttttaataggaatggatgttgagttttgttaaaggttttttttgtttttattgagatgtttatatggttttttgtttttagtttgttaatatagtgaatgatatttgatttttaaatgttaaattaatttaatatttttaaattaagtattagttttttataatgtagtatttatttatatattgttggatttaatttattaatatttggttaaggagatttgtgtttagatttatagaatattaatagtttttttttttagtaatatttttggattagtattagtgtaatattggttttaaataatgagttggggaaatattttttttttagttttttggtagtttgtatagaattggtattatttttttttaagtgttttgtagaatttattagtgaagttatttgtgtttgggagatttttataattataaatataatttttttaatagatatatagatttttaggttgttttttttatgttttagtaatttgtgttttttagggaagttgtttattttattttatttgttaagtaaatataggtataaaggtgtttgtaatagttttttagtatttttttaatatttgtagattttaataatgttatttgttttgtttatgatattggtaaaagtttgttattaaggatatgtgttttagattgttatgtattttttattaattgatttttttattattgtgaaatgattatttttatatttggtaatgttattttttttataatttgtttaatattgaaatagttattttattttttttttgattagtgttagtatagtatatttttttttatttttttatttttaatttatttgtgtttttttatttaaaatgtattttttattggtaatatggagtggggtggttttttttttttatttaatttaataatttttgttttttaattggaatgttatataatttgtatttaatgagattattgatatggttagatttatgtttgttattttatttgtttttggtttgttttatgtgttatttgtttttttttttttgttttttgttgtttttttaattgagtagtttttatttttttgtttgttttattggttatgattagtttttgttttttagaatatatgatttaatggatttattagaggtatttttaggtattggtatttttttaatagatttttagatttgtgaattattggattaaatgagttttatggtaatttttaatttattagttatgtgattttggttaagttatttgattttttttaatttaatttttttatttataaaatggatataaggaaatatatttatttgtaagttaaaaatatttaaagtattttaaatagtattatgtttatgtggtttaaattttaaaaggtatatagagatttaatatattttattttatatttttttattttttgaattgtagatttttgtattaatagatttaggtaaaattatttttaaaaatttagaatgaagggttttatttttataattattgaaaatttgaaaatttggtttttgatttgttaatatgatttaaattataattttaaaatttattgtgttatagtttttagagaaaggtaaaaaatattttagattttttttagtgtataataggtttttttaggataggagtatgatttttgaaattaatttaatgtattttttgttttgtgttttttttatagg

SEQ ID NO: 716 - DNA, 12610 bp, Artificial Sequence
  chemically treated genomic DNA (Homo sapiens)
tttgtggaagaggtataaaataaaaaatgtattaaattgattttaaaagttatatttttgttttgaaaagatttattatgtattaagaaaaatttaagatattttttatttttttttagaaattataatatagtaaattttaaaattataatttaaattatattaataagttaaaaattaggtttttgagtttttaatggttgtaaggataaaattttttattttgagtttttgaaaataattttatttaaatttattaatataaaaatttataatttaaaaaataaaaaagtataaaatagaatatattaaatttttgtgtattttttaaagtttgaattatatgaatataatattatttaaaatattttaaatatttttaatttgtagatgaatatatttttttatatttattttatagatgaggaaattgaattaagagaggttaaataatttgattaaagttatatagttagtaaattgaaagttattatggagtttatttagtttagtggtttataaatttgggaatttattaaagaaatgttaatatttaggagtatttttagtaagtttattaaattatatattttgaggggtaaggattggttataattaataagataagtagggagataaaaattatttaattgaaaaggtagtaggaaataaagaaaagagaataaataatatatgggataagttaaaaataaataagatgatagatgtaaatttaattatattaataattttattaaatgtaaattgtatagtattttaattgaaaagtagagattgttagattgaataagaaagaaagattgttttattttatgttgttaatgagaaatgtattttaaataaaaagatataaataggttaaaagtaaaaggataggagaaaatatattatgttagtattaattaaaagaaaggtgaagtgattattttaatgttagatagattataggaaaaataatattattaggtataaaagtggttattttatagtgataaaggggttaattaataaaaagtatataataatttaaaatatgtgtttttaataatagatttttgttaatattataaataagatagataatattgttagagtttgtagatattaaaaggatattgaagaattattataaatatttttgtgtttgtatttatttgataagtgagatgaaatggataatttttttgaaagatataaattattaaagtataagaagaataatttgaaaatttatatatttattaaagaaattatatttgtagttataaaaattttttagatatagatggttttattggtaaattttataaaatatttaggaaggaataatattaattttatataaattgttaaaaaattgaagaaggaatatttttttaatttattatttgaggttagtattatattgatattaatttaaagatattattagaaaagaaaattattaatattttatgaatttagatataaatttttttagttaaatattagtaaattaaatttaataatatataaatggatattatattgtgaaaaattggtgtttagtttggaaatgttggattggtttaatatttaaaaattaaatgttatttattatattagtaaattaaaaataaaaaattatataaatattttaatagagatagaaaaagtttttgataaaatttaatatttatttttgttaaaaaaaaaaattgtagtaaagtataagggaatttttttaatttgattaaaaatatttatgaaaaatttatagtaatatgagatttaatggtaaaaaaatttgataatttttttttaagattatgaataatataagtatgtttgttttttttatttttagttaatattgtagtggaagttttggttaatgtaatttagtaaaaaaaaaaaaaaaaagaaaaaagaaaaaaatagaaaagaaataaaaggtatttagaatggaaaggtagaaataaaagtgtgatattttatgtggaaaatttaatgggatttattattaattgtatttttatatgttaataataattaataagaaattgaaatgttaaaaaaatttatataggtataaaaaaatgatatttgaggataaatttaattaaggatttgattattgaaaattattaaatattgttgagatagttaaaaggtttattaatttaaaaagatttttttagagatagaatatttttattaagatattaatattttttaaaatgagttatagattttaggtaattttaattaaaatttgggtaggttttttttttaaaatttgataagttaatttttaaagtttatatggaaatgtaaagaatgtatataatagttaaaataatattgaaaaagaataaggtaaaatagttagtattatttggttttaagatttgttataaagttttagtaattaaaattgtgtagtattggaattaaaatatatgaatagattaatggaaagtaaaggaatagatttatgtatatataaaaattgaaatttgataaagatgtaaaggtaatttagagagaaaagaatagttattaagaaaaaaaaagtgttggttaaattggatatttatatttatatggaaaaaattaaaataaaaattttttatatatatttggtattagttaaaagtaattaaaaatagattatagatttaaatgtagtttgaaattataaaatttgtaagaaaaaaaaataatataattttgtgattttgggttaggtaaagatttttaggtagtataataaaagtataatttataaaataaaagattagtaaattggattttattaaaattaaaaattataatttaaaaatattattaatggaatgaaaagataaattatagattgagagaaaaatttttgtaaagtatatgtttaataagggatttaaatttagaatatataagaattttttaaaatttaaaaataatttttaaaaatttaatttaaaaatgagtaaaaggtttaattagatattttattaaaaaatatatataaggttaggtgtggtggtttatatttgtaattttagtattttgggaggttgaggtgggtggattatgaggttaggagattaagattattttggttaatatggtgaaattttgtttttattaaaaatataaaaaattagttgggtatggttgtgggtatttgtagttttagttatttaggaggttgaggtaggagaatggtgtgaatttgaaaggtagagtttgaagtaagttgagattatgttattgtattttagtttgggtaatagagtgagattttattttgaaaaaaaaaaaaagaatatatataatggtaaataagtagattaaatgatagttaatatttttaattattagaaaaatgtaaattaaagttatagtgagaaattattatatatttattgggatgatttaaattaaatataatgattatagtaagtattggtgaggatttggaataattggtatgtttatattttggtggtgggaaagtaaaatgtataattattttgaaaaataatttggtagttttttataaagtttaataaatatttattatatgatttagttattttatttttagtaatttatttaagataaagaaaagtatatagttatataaagatttgtatttgaaggttgaggtaggagaatagtttgaatgtaggatgtggaggttgtagtgagttgagattgagttattgtattttagtttggtgatagagtaggattttgttttaaaaaaaaaattgaaataaataaataaataaaagatttgtatttgaattgtagttttatttttatttaatagttttaaattggaaataatataaatgtatattaataggtgagtggataaataaattgtagtatataaatataatagattatttattatttagtaataaaaaggaatgaattattgttataagtaatagtatgattatattttagaataattatattgaatgaaaagagttagattattaaaaaaatatatattgtatgattttatatatagtattttttaagttttagaataggggtgtttaattttttggtttttttgggttatattggaaaaagaattattttgggttatatataaaatatattaatattaattagagttgataagtttaaaaaaattgtaaaaaaattttataatgttttaagaaagtttattaatttgtattgggttgtagttaaagttattttgggttatatgaggtttataggtagtagattggataaggttgtttgagaaattataaataaatatagagtgatagaaaatattagtagtgttttgtaatgaggtagggagaagtgggaaggaaggattattgatagatatgatgaaatttttggaggtaatggatatatttatggttttagttgtggtggttttataggtgagtgtatatatatttattaaaattaattaaattgtatattttaattatatatagtttattgtattttaattagagtttaaaagagttgttaaaataatttatatgaagatatttttgaataatattatgttatttaaattagaatagtgtttatattttggttagaatattgttttaaaaatttattaatattattataattttgtattaattatttgttattttttagaaagttaatttttattaggaaattaggataattagtgaaaagaaatattattttagaatttttttaaaaatagaaatttgattttataatagtattttaatatattgtaatagtttattttatattttataaaaagtattttttttagtgattaatatgtaatatttatttaatgtttataataattttgggaaggatttgaagtaagtattattttgtttttattttagataagaaaattaaggtatagtggggttaagtaagttgttaaagatatagaattgataagttatagaattggaatttgaatttaaagagtttggttgtagtgttttagtttttaaatattatatttatattgtttttttatgattaaataataagatatatgtttttatgaaagagatgatataggaattgaaaattatagttatagtaatgataggaataaagattttaaaaatgataaaattatgttgggtgtggtggtttatgtttgtagttttagtgttttgggaggttgaggtgggtagattatgaggttaggagtttgagattagtttggttaatatggtgaaattttgtgtttattaataatataaaaattagttaggtgtggtggtatatgtttgtagttttagttatttaggaggttgaggtatgataattatttgaatttgggaggtggaggttgtggtgagttgagattatatgattgtattttagtttgggtaatatagtgagattttgttttaaaaaaaaaaaaggtaaaattggtattattttggtagtttttttttttttttttttttttgagatatagttttgttttgttgtttaggttggagtgttatggtgtaattttagtttattgtaatttttgttttttgggtttaagtaatttttttgttttagttttttgagtagttgggattataggtgtttgttattatattaggttaatttttgtatttttagtatagatagggttttagtatgttggttaggttaattttgagtttttgattttaagtgatttatttttttagttttttaaagtgttgaaattataggtgtgggttattatgtttggtttgtattttttttaaatatggtttttaatttttaaattttttttatatattttagttatttatattatatatgtattgtatatattgtatattatatatgtattgtatatatttattttaataattattatttaattttaaaaattttttaagatgagttttggtataagttaaagttgaaaatttaagtaattatgataatgttttgattaagagttttaaaatatatatgaaagagggaaaaaaatttgttaatttattagagatagttatttttttattgttgagaggtagaatagattatatgttaaattaagttataagaaatatataggtaaatatatatatgtgtgtgtatatgtgtatatatttataggaataatattagtgataatggaattttatgttttagtttttttttgttttttttttgttaaaggaggagaattattatgtatttagaattatgatttttgttattggaatagttggagaatatgttatttaattttttaaattttttaaatgaggaaattaagatatattgaagttaatggttttgtttaaggtgaaataattaggtaataataaaattataattaaaatagattggttttttaatttattagtaatatttttagaaataattataatatttgattaatataattatttagagtgttgattttttaaaataaaaagaaaaaatatatagtaatttgatagtttttttttttagaataaaaaagtataagtagtatatttggattttagttttatatatatttatttaaaagtggataaaatttaatttaagtaataattattatgtgattatattaaagggatagttatatatttttttaaaattgaaatgttaattagttttttaattattttatatgagtataagataagtaataatatttagaaatataaggagtaaaattattttggataaatatattatttttgtattataatatattttttttttttttttttttaattgagatagagttttgttgtgttatttaggttggagtgtagtagtataattttggtttattgtaatttttgttttttgggtttaagttatttttgtgttttagttatttttaaatttgagattattggtatatgttattatatttgttaatttttgtatttttattagagatggggttttgttatgttggttaggttggttttgaatttttggttttaagtgatttgtttgttttagttttttaaagtgttgggattataggtgtgagttattatgtttagtttatgttttttaaaaatgtattttatggggatttaagatttttaaagttttgaaaaaagtagttttttatttaataaaatattatattgaataggttaaaaattatatagtaaaaaaaaatggttatttttgatagggtatattgaagtattagagagttaagatttaatattttaatttgagtagtaatattatatatttgattgtatgtattgtttgtatgttatattttaatatgaaagttttaaataaatatataaaaaataagaataaaataaaattagaaagttagaaaaatatatttaatttttatagtatttgattttgattgttttgtaaaggtattattgttaattttttttaaggaaaggtaaaatgtatattagttttttttatttttagggttagaaggggtttgtaggttattaaggtataaagatagggttttaaaatgttattttagtaatatttaagtagttttgtatatatggaggttgtttttttatataagttgaaagatttattgaatgtttaatttggaagtggtttattaattgataggatgaaaagaatagtgattgttaaaaaaaaaaaaaaaaaaaaaaaaaaaaaaaaagaattagaatattaaaaattgtatttgagttatttaaatatttttgttaaaaatattttaattagtggtttatttaagtttaaattatgtaataatgttgattttttttttttttttttttatatttaattgttaaaaagattttatttaattttttagtattgtttatatttttttttatttttattgtaatttatttagtataagtttttattattttttgttggagtattgtaaagtttttttaattttagtattttattttttttaagaaataatattttttattttgtattatggttatttttatattttattttgttttgtataatttttttttagagtattttatttatttggtatttttagttattatttgtaaagtaagatttgaaaaaaaagtttgattgttttattatgagtagaatgatttgaaaaattatgatggtgaataattattttatttaaagttgatttgttaagaataaaatttttaattaaaagaaaatttttttaaatgaaaattagtttaaattttttgaaaaattataagaaaaaagagttagaaaagagattatagaatgtgtggtatttggtagggaaggaaatagaattaaggagatattttattagtatgttgtgaagaaaaatgatatttattatttgggattgttagttttaggatatatatgaataaaagttgagaataaattttataaattgttttagtaattatagttattatttttttaaatattgttagtgttattgttttataaatatttgttaatttgaataattttaatgttaattggaggtaaaatttaaaggttgtttttttttttttaataaaaaatagaaattgggttttttagtgattatagaatagaattttttttttagtaattaagaatatttttattttgtagaaaatttttttttgtgattaataaaagaggagaattgatatttattgattgtttattatgaattatgtattattaaaatgttaatatataatttaaaaagttattttatgatatagatattattgtttttgttttattgaattaaatatagagtaagtatatttagtgattttatttaaatttaggtatatttaatttaaaagttaagaatattttatgaataaggaatatttttaataatttagtgatattattatttttaagataaattttttaattagttgtattaaaatagggaaaatgtgattaagttatattttgattttattaattatattgattggtaggtaggaatattttttgagatttgtatttatttaatgtttttatttatttaaatgaatatatattagtatttattatgttttagttgttattttggatttggaagttgggaaatattattaattttgtatggggaaattttgtgtttatttttagttgttatgagtttgtttataaatttatttttgaggaatgtaagaaattaaggaggtaggatgtttattagttttgtttattttggtatttataggttttagttaaagttgggtatatagtaggtatttaaatatttgttgaatggaaggaaattaatattttttgagtatttgaatgtttaagataatgtttgattattttattggaattttaaggataattaaaagaggtaggttttttattatttttgtttaatagatgaggttgatagatttagatttatttatttaggatttaaagggattgatttgaaagtttaaggttttttttatattatattttatttaagaaattttttaattgtgtgtatattgttttagtgtgatttttgaaatgttttttagattattaatttgataagtattttatgttattttatattttagttgttttaaaatattttttagaatggaataatgttaatataatttaattttaatattaaatttttttaaaaattataaagataaaaatttgaggtatattagaatgagatttaaaattatgaggtaatgtatttttattaaggttttttgaagaaatgataattttaggaaattaagaatgagagttttgttatgttaatggaaaaaaaatataattaaaaaaagaatgttatattagaaattgatagattaaatgtattatatttttttttgttgaaatttttggtaaattgttagaggtttttttaagtagttttaatatattataatttataaaataagtaaagttaaaatttatgtttggtatatattaaataggtgttgtatttttaaaattttatttatgaatttttttatattaaaatttgaaaattatatgatttagtatagtttagaatatttttaaattataattttttgaagtgggttagaaaatattataaagtttttaaaataaaatttatttgaatttatttaaatttgataaataaaggtttgagtagtggtttgtaagagaaggggaaatagaagtggagtgtgagagttggtagtaaaattgaatattttgtgttatgtttggtaattgagagttaggtttttaagtatgtgatattattggggtggttttgaaggtggagtaaggtttttagaataatttaaaaggaaagagttttataatttaagtggttttattttagattatttatgtgaaatttgttgatgaaaaaaaaattatatttattgtatagatgagaaaaataggagtgtttttaggttatataagttgatgtttggtgtttggtgtgatgtgaaatgttttaagttgttggagttggatattaggtgaattgagatttaaattgtggaaaaattggtttggagaggtataaggtttgtagatggagggtagtaaggttatgtaaatttttttgaggaaggtggttttggaggttgtgtgttttttgggttggtattttatagtttagttttttatgtgtgagtggagtatggtgaatgttgtatgtttgggttttgtttttagttgtagtttttttattttagaggttattttgatttggaaatagtatttagagtagttgttgggtgttgagggaggtttggtggaagggtgaaaggaaggtgggagggtgggaagtgtgtggttaggtggagggttgatggtgaagggtagataatgttttagaggttagggttggggttgggatgggggtagggagaggaaagttttttttaggtatgtgtgaattgtatatatttatttgtttttttttttttttgtttgtttggtggaggttttgagttgttgtgggttgtgtgtgtatataaggtgtgtttatgtgtgttgtttgttttttttttgagtttgtgttttgtttgtttatttttagttttgtttatttaaagttgggtgtgtgttttgtagtagtttgtgttgtttttgtgtagttgttatggttgtttttttattgggaaatttgtttttagttttttttttagttttgtttttagttttttttgaaggtggtttttggttgtttttaggtttttgtttttgtattttgttttaggttttggttggtttaataggtgagaggttatgggtttgatgttgagattgggagttaatgagttttgggagtggggtaagtggtgataggtatgttaggtttggtgaggggtagttttttgggattattgtgagttgttttgattgtttatttttggagtgtttgtttttgttagatgtttttattttttttttatgtagagtgttttttttttagtaaagtttttttttgtttaatttatagaatttttgtgttagatgtgattaaggaaaatatattgtaataaatgagggatttttttttgttttaggaagatttggatgtggttagatagattttttttttttagttattttgttattttaaagatgtggaatgttgagtttaatttaagatgtagtttttttttagtaatttttaattgaattgtgttgaattagaaatgaagaagtggtattttattgtgtttatgtatttgttttttatatgtattttggatttgttttttttttaatttgagatgtttttttttttagtgtttttttttttgtagtttgatttttttttttattttgtatgttatgaaaggggttgttatgtgtaggggatttttagaatattatgttttatagttgtaaagtgattggtgagggagaagtgaatagggtttaaggttaaaattagtttatgtaaattgtttttaataagtttttttttttatatgtttttaatttttttttttattatagttgtttttgtttttttattttgatttagtaattatttatttatttaattttgtgataatttattataattgttttttttttaatttgtattatgttttttattaataatttaatttttaagatgggaaagatgtgtttatggtttgtgttttggaatggttttgtgtaaagttgggtaaaattatttaatttgtttattttaatttttttattagtaaaatggttataatagtgtttattttatgtagtagtaatgtttgtaaagtttttttagtatagagtttggtatatagtaaatatttatagataatagttgttgttgtagttattattattattgtattattattgtattattatagtattatttttggtaattgtattttttaaaggttatgtaattttttttagttttttaaatatttgttttaattttaatttttagaattttaatgtttaaattttaatataaaatttttaaattttttttggatttaaaaaattgagttatttagttgggtatggtaatttatgtttgtaattttagtattttgggaggttgaggtaggaggaatgtttgagtttaggaatttaagattagtttaggtaatgggtgaaattttgtttttataaataatttaaaaattagttaggtttggtg

SEQ ID NO: 717 - DNA, 8172 bp, Artificial Sequence
  chemically treated genomic DNA (Homo sapiens)
taggttatagttattgtttgggttataaagtttttaattgtaaataatagaatttattttaggttatttgaggtggaaagagatttgttagagaatttaagtttttattaatggttagagatataggtttttttggtataagtttaggtagagtattgaaattatattgttgtttggttttagtaagattattttgttattagttatagttatagtttttatgtattgatattgtatattggattttaagaaatttttgttttaagagttagaattttttatattattatttttagggagattttgtatgatgttagtgtttttggattttttttgaagaggattttttgagaggagagtgtttgtggagttgaggtttgtgtttgtattttggaggtaagtaggtgagggtagtaaattttagttttttttaatgtaaggtagaattttttattttatattgtgggaagttttttaaatttggagttttaaaagaatttaaggggttatagtgtatgatgaatgtgttttgattttttggaatttagagttgatgaatatttaatttatgtaggtaaaggtagaagtgtgtggtattgttggtgagtgaggaggtagttagatagtattatagtttttttaaggagtaggagagtgattttaagttgtgttaggggtggtgaggttgattttagggagggtagaggatggtgttggaaagggttattgtggttagtttagatgagttttaaggattttttggttaggagtatgaatttttatttgtgggtagagggattttaggttaaattttaggaattgtagtaagttgtggtgaggagtgaggggattttttgggataaaattgttttatgagtttaattgtattttttaaaaatttattggtttaagttttaatttttaatattttagaatgtgattgtaatggagatatggtttttaaagaggtggtttaggtaaaatgagatagttagagtggattttaatttaatatagttagtgtttttattagaagaggaaatttggatatagagagagatgttagggatgtatgttatgtaagaggtagtaagagtatggttatttgtaaattaaagagagagggtttagaggaaaataagttttttttaatggtttgattttatatttttagtttttagaattgtgagtaaataaatttttttagttaaagttatttagttgtagtgttttgttgtggtggtagagtaaatagataaagtagtaagtttttttagtattttaggaggttttgtttgttgttattttttaaaggttattttagttatgatgagggtaggtgtggttgtttgggaggagattattgtggaataaagagaaataaggtttgtttgatgtagtagggagtagattatagatttaagaagggttttagaaaggtttagtaatttagtttgttagggaattttgagttgtatgtagtttttgtttttttgtgttttgtaggatggtttgatttatttttgtttttatgttagattttaagggtagggttatttgggttatagatttaggtttggtgggtttggtgggttgatttgtgggttatttttatgtttttaggaaatttatttttattatttggttgttgtgattggtattgttgaggttgtttttttgtgtataaaattgaataaggatatattatgtgttagtaatttattagtatagggtgaaggtttagtaaagagaagttttttttttttttgtttttttaggttagtagtaaatgtagattggggtggggataaggtaaatatataatttgggtggagatgtgattgattaataatttataaattatttgaaattatattttttttttgatagttaattttttgtaaatatttaatgtgtttttattttgttattatttttaatgatgttgaatgtgtggttgttttttttagtataaaagtttgatgtagttttgtttggatgtatttgtttataaggagttttgtttattataatggtaggtaattggttttatatataaaggttagaaaagtaaaagagaatatgtatttttattttaatatgtgtgtgtttttattatatagtattgaatggtaaatgtgatttagttaggaattttatgttattatttgtaatttaatgtgtagagtatgagagtttgagagtttgtgaaaattgtaatgagtttagtattagttttgttttttaagatttaagttgtttttttttttagtaattttggggtttaattagattttataagtgtttttaatttttgggttttatgtgagtaatttgaaattaaaaataattttagagttatatgattgtattgtttttgagatgagggaattgagtttggggaggggaagaagttgttattggggttttattgtaagtttgtgaatgagttgagataggaatttaggtatttttttttttttgttaggggtttttaaatttggttgtgtagtggaaattttgggggaattttgaagaatattgatatttattttttattttgatattttgatttaattgggttgtagtgagaatagagtattaatttaaaaagttgtttaggttattttaatatttaagtttgggaattatttttttaggttttttttattgtattatgtgttaaggaaaaattttgggtttggggttgtgtttgttggtttatttgtttgtttttgagataggattttattttgttgtttaggttggagtgtagtggtgtagttatgatttattgtagtttggatttttttgggtttaggtgatttttttattttagttttttaagtagttgggattataggtgagtgttattatgtttgattaatttttgtatttgttttagagataggattttgttatgttgtttaggttggttttgaatttttgggtttatgtaatttgtttattttagttttttaaagtggtgggattattggtgtgaattattgtgtttggttaagaaagaattttgttttaaaatttataaaaatttatgtaggttttttttgtgttttaaatttgattttttttaaaatattttttattaatgttggggattgaattgggttgttttgggggttgtaagggagatgaggtaagaaatagttagttaagtgggaggagttaagggaggtgggagagggtttttaggaggggattttgggttttttttgggttatttggtaagataaatttgtttttagaaattgtttggaggtagaattggggatggtaaaataatagtggggtgggaggttttttttatttttattagataggtttttttagtttatattttatgtagttttatagtgaatttagtaagttgtagagttggtaatatttttgtttgtttaagattttgaggatttttaattttttatttatttatttatttattttattattgttatttgtagtagagatgagtttttattatgttgtttaggttggtttttaatttttgggtttaagtgatttttttattttggttttttaaagtgttgggattataggtgtgagaaattatgtttggttagatttttaatttttgattatgggataatttttttaggagtagtaatttatttaaagagatataatttttttttttttttttttttttttttttttgagatggagtttttttgttgtttaggttggagtgtagtggtgtaattttggtttattgtaagttttattttttgggtttatgttatttttttgttttagttttttgagtagttgggattataggtgtttgttattatgtttagttaattttttgtatttttagtagagatggggttttattatgttagttaggatggttttgattttttgattttatgatttatttgttttggttttttaaagtgttgggattataggtgtgagttattgtgtttagttaagagatataatttttaaggatattgttagtttgttttattttaaggtttgttgtattatttagaaaattttagtttattttggtgttgtggtgtaattttttgtatatattaggagtttagggttattaaatgtaggaaaggaagatataaagggaaggaaggttggtggtagaatagaagataggaatgaaaaaagttttagagtttttttatttaggggtggattttagattagtagtgtgggtattatttgggagtttttgtgtaagtttaaagatttattgaagtagaatttgtaggttaattaataggttgtttggttgggtgtggtggtttatgtttataattttagtattttgggaggttgaggtgggtggattatttgaggttaggtatttgagattagtttggttaatatgatgaaattatgtttttattataaatataaaaattagttaggtgtggtggtgtatttttgtaattttagttatttaggaggttgaggtaggagaattatttgaatttgggaggtggaggttgtagtgagttaagattgtattattgaattttattttaggtgatagaatgagattttgttttaaaaagaaataaataaatagataaataaaataaaataaaaaaaatttttaggaatttatatgtatattaaagtagtattgggttggttattgtttttgggtttttatttgggagattaggtaaagatattgaggtattggtttttagattgtgttttttatgagttttttggataattttaatggttatttaaatgggagaatttttttttttatagggaaggaaaattgagttttagagagagagagagagagagatagaaagggagggagggagggagggagagagagagagagatagtattaggttatttttgagatattgttaagtggataattttaaaattaaataatttgttttttgttgttattatgtttgggtttttttttagtggtttaattttttgtttttgttttagagttgtaggagatttggggattttgtatatgttatttgttttgggatgtagttttgtttgtttttgttgatttttttgttttgtgatttagtgaaattagatttttaagattttagtgatttttagtattttaggagttttttttttgtatgaagggagtaaaaatgttgttaataaggttggttttttggggggaaaagtttaggtttttataatgattttgagttgaaggttatttagaagaatgaaatagaataagtgttattttaagttttggtttgagttgaatgtattaaggtgttgtgttatttttaaagaatttttttttttttgtggttataaaatttatatattttattgtagaaaatttagaaaataagaggaaaagtttaaagaagaaaattgttataatttttttatttaaagatgatttgttatttggtataaaatttttagtgtgttttgagtatttttttttgtattatgtattttatagtttgttttattttatgttgtgatatgtggtgattaattgtttatgtgattttattttttattttgttggtttattaggtgtttttttgagttattgttttttattggttttgtttttgggtattttgtttttttttatttttttattgtagtgagtattgttgtggaggagtttgtttttgtttttgtttttgtgttatttttaggattatattttggagatgaaaaggtgaaattaaatgttgtaaatggttttaagaatgtggatatatagtagtaaattgttttttttaatgattgtttaaagtaagttatttttgtgtatattattttttatagatatttttatttttttttgggtattataaattaaatgattatttttattattttattatgtttttattttatgttatatatttatattttttttgttattagtaagttgaatttttttatgtgtttatttattatttttgtgtgtgtgtgtttgtgtgtgaaatgttattttattttttttgttttttttttgtttaagatgtttttttttttttattggtatgtaatgatattgttttgaaaatttgatatttttttaattttagttatgtttttatgatgtttatatttttaaatttattttttttttatgtttagaataagtatttatgtatatatgttgtgattattttatgattttattgtaaaaatttaaattttgaatttttttagaatttattttattaatggggatttaaataggaaattaatttttttttttttttaaatagtttattatttgttttaatagtatttattgaataattgttttttatagattttaaagaatatgtttattttataataaatttttatatatatttatattttttgggttttgttttttttttttttattttatttaattatttttggaattttttgggttttttattttgatttttgtgtttgtttttttttttttaaagatagggttttattttgttgtttaggttggagtgtagtggtgttattatggtttattgtagttttaatttttttgggtttaagtgattttttattttagttttttaagtagtagagattatagggatatattattatatttatttaatttttgtattttttgtagagatgggtttttattatgttgtttaggttggttttgaatttttgagtttaagtgatgtgtttgttttagttttttaaattgttgagattatagaattgagatattgtgttttttttatttttttatttatatatgagtaatatattattttaagtagtgttattttataattaattttagtaattttatagaataaatgtttttatttttattgttaaaagataaaattataataaatttagtttaaagattttaattgattttttttttttttttttttttgagatggagttttatttttttgtttaggttagagtgtggtggtataattttggtttattgtaatttttgttttttaggtttaagtgatttttttattttagttttttgagtatttgggattattggtgtgtgttgttatgtttagttaattttttggtattttagtagagaatgggttttattatgttgtttagggtggttttaattgtttgagtttaggtaatttatttatttttgttttttaaagtgttaggattataggtatgagttattatgtttggtttttaattaatttttatttgtgagtttataattagggaatattttattttataaaatagattgagtgttttgtagagttgattagagaagtttggttttttttttttttgagatggagttttgttttgttatttaggttggagtgtagtggttagattttggtttattgtaaggtttgttttttgggtttgtgttatttttttgttttagatttttgagtagttgggattataggtatttattattatatttggttaattttttgtatttttagtagagatggggttttattgtgttagttaggatggttttgattttttgattttatgatttatttgttttggttttttagagtgttgggattataggtgtgagttattgtgtttggtagagaagtttggttttatagatagaaaagagttagaaaaagtagaaatagagaataaaaagtaaattggtttttttgaagtgattttgtttataagttaaagtagaggggatttttttattatgttagttaaaattggtttgttgggtatttggttattattttttatttttttttaattttttagaaggttggttaagtaatttagttttggtttagtggtagagaattttagtatgggtgattgtattttggtttggtttgttgggtttagtgtagtttagtttaaataaatggtttttttaatattttttttaatattatttttttttttaaaagtttttagaaattattatgttaaggtttgtttgtttatttagtttattttaaaaagatgataaagttaattagatatttttttttgttttataattttagtttagattaattggtttgtttagttatgagttttatattataattttttagtagagtttagttgagattttggtatatagtatttagttaaggattattttttgaattaatttattttttattttgatttttttttata

SEQ ID NO: 718 - DNA, 8172 bp, Artificial Sequence
  chemically treated genomic DNA (Homo sapiens)
tgtgaagaaaggttagggtggagaatgaattaatttaaaggataatttttgattgagtgttgtgtattaggattttggttgggttttgttgagaggttatgatgtggagtttataattgaataaattagttaatttaggttgaaattgtagaataaggaaaagtatttagttgattttgttatttttttgagatgagttaaataaataaataaattttaatatggtaatttttgggaatttttgaaagggaagatggtgttaaaaaaaatgttgaggaggttatttgtttggattgagttgtattgggtttaatagattaaattaaaatgtagttgtttatgttgaagttttttgttattaagttaaaattaagttgtttaattaattttttaagaaattagaagagagtgagaggtaatagttaaatgtttaataggttagttttagttgatatgatgagaaagttttttttgttttaatttataagtaaagttattttgaaaagattaatttgttttttgttttttgtttttgttttttttggtttttttttgtttataaagttaaatttttttgttaggtatggtggtttatgtttgtgattttagtattttgggaggttaaggtgggtggattatgaggttaggagattgagattattttggttaatatggtgaaattttgtttttattaaaaatataaaaaattagttgggtgtggtggtgggtgtttgtagttttagttatttgggagtttgaggtaggagaatggtatgaatttaggaggtggattttgtagtgagttgagatttggttattgtattttagtttgggtgatagagtgagattttgttttaaaaaaaaaaaaagttaaatttttttggttagttttgtagaatatttgatttattttatggaatgaagtgttttttgattatagatttataagtaaaagttaattgagggttaggtgtggtggtttatgtttgtaattttagtattttgggaggtggaggtgggtggattgtttgaatttaggtaattgaaattattttgggtaatatgatgaaatttattttttattaaaatattaaaaaattagttgggtgtggtggtatatgttagtaattttaggtatttgggaggttgaggtgggagaattatttgagtttgggaggtggaggttgtagtgagttaagattgtgttattgtattttagtttgggtaagagagtgagattttgttttaaaaaaaaaaaaaaaaaaaaaattaattaagatttttaaattaaatttgttgtaattttgttttttgataatgggaatgaaggtatttattttgtaagattgttaaaattaattatgaagtgatgttatttgaagtagtatgttatttatatatgaatagaaagatagggagggtatagtgttttaattttgtaattttagtaatttgggaagttgaggtaggtatattgtttgagtttaggagtttaagattagtttaggtaatatggtgaaaatttatttttataaaaagtataaaagttaggtgggtatggtggtgtgtttttgtagtttttgttatttgggaggttgaggtggagaattatttgagtttaggaaggttgaggttgtagtgagttatgatagtattattgtattttagtttgggtaatagagtgaaattttgtttttaaaaaaaaaaaggtaaatatagagattaaaatagaaaatttagaaaattttaaaggtagttggatagggtaaaaaagaaaaaaataaaatttagaaagtataaatatatgtagaagtttattataaaataaatatgttttttgagatttgtggagagtgattatttaataaatgttattagaataagtggtgaattatttggggaagaaaaaaagttaattttttatttgagtttttattagtgaaataaattttaaaaggatttaaggtttaagtttttataataagattataaaataattatagtatatatatataaatatttattttaagtataaaagaaaaatagatttgagaatataaatgttataagaatataattgaaattagaaagatattaaatttttagaataatattattatatattaatgggagaagaaaaatattttaaatagaaaaagggtaagagaaataaagtggtattttatatatagatatatatatatagaaatgatgaataaatatatgaaaaagtttaatttattgataataaaagaaatgtaaatatgtagtatgaaatagaagtataatgggatggtgagaataattatttaatttataatatttagagggaaatagaggtatttatgggaggtgatatgtataagaatgatttattttgaataattgttaaggagaataatttgttattatatatttatatttttaaaattgtttataatatttgattttatttttttatttttaagatgtgattttaaaaatggtatagagatagagatagagatagatttttttataatgatgtttattgtagtggaaaaatggaaagaaataaaatgtttaagaatagagttagtggagaatagtgatttagaaaaatatttggtgagttagtaaggtagaaggtgaagttatatgagtaattgattattatatgttatgatatgaaatgaagtaggttatgaaatatatgatgtggagagagatgtttagaatatattgagggttttgtattaaataataagttatttttggatggggagattatgataatttttttttttggatttttttttttattttttaaattttttataataaaatatatgagttttatagttataaagaaagaaagattttttaaaaatgatataatgttttgatatatttagtttaagttaggatttggagtggtatttgttttgttttatttttttgagtagtttttagtttgaaattattgtggaaatttaaatttttttttttaaaaagttagttttgttgatagtatttttattttttttatgtagaaagagggtttttggggtattggggattattggaattttggggatttggttttattgagttataaagtaggagagttaatagggataagtagggttgtattttaggataagtgatatgtgtaaaatttttaagttttttgtagttttagagtagaggtaggagattgaattattgggggagagtttaaatatggtgatagtagagagtaaattatttaattttgagattatttatttgatagtattttagaaatagtttaatgttgtttttttttttttttttttttttttttttttttttttttgtttttttttttttttttttttgaaatttagttttttttttttgtaaaaagaggggtttttttatttgggtgattattagagttatttagggagtttataggaaatataatttaggagttagtgttttagtgtttttatttagttttttaggtgagaatttaggaataatgattaatttagtgttgttttaatgtgtatataaatttttgggagttttttttgttttgttttgtttgtttgtttgtttgtttttttttgggatggaattttgttttattgtttagagtagagtttagtgatgtaattttggtttattgtaatttttgttttttgggtttaagtgatttttttgttttagttttttgagtagttgggattataggagtgtattattatatttggttaatttttgtatttgtagtagagatgtagttttattatgttggttaggttggttttaaatatttgattttaaatgatttgtttgttttggttttttaaagtgttgggattatgggtgtgagttattgtgtttaattagatagtttgttaattaatttgtagattttgttttagtaggtttttagatttatatggaagtttttaggtgatgtttatgttgttggtttgaggtttatttttgagtagagaggttttaaagttttttttatttttgttttttattttgttattagttttttttttttttgtgttttttttttttgtatttagtaattttgagtttttgatgtgtgtaggagattatattatgatgttagaatgggttaggattttttagatggtatagtgagttttgaggtgaagtaggttggtagtatttttagaagttgtgttttttggttgggtgtggtggtttatgtttgtaattttagtattttgggaggttgaggtgggtggattatgaggttaggagattgagattattttggttaatatggtgaaattttgtttttattaaaaatataaaaaattagttgggtgtggtggtgggtgtttgtagttttagttatttaggaggttgaggtaggagaatggtgtgaatttgggaggtggagtttgtagtgagttgagattgtgttattgtattttagtttgggtgatagagagattttgttttagaaaaaaaaaaaaaaaaaaaaaaaaaaaagttgtatttttttaggtaaattattgtttttggaagggttattttatgattaagagttgggggtttggttaggtataattttttatatttgtaattttagtattttgggaagttaaggtgggaggattatttgggtttaagagttagagattagtttgggtaatatagtaaaaatttatttttattataaataataataataaaataaataaataaataaataaagagttgggggtttttaggattttaggtaggtagaggtattgttagttttgtagtttgttaagtttattgtgaggttgtatagagtataggttggaggagtttgtttagtggagatggggaggattttttattttattgttgttttattatttttagttttgtttttggatagtttttgagagtaagtttgttttgttgagtggtttagaggaggtttggggtttttttttgaggatttttttttattttttttggttttttttatttggttggttgttttttgttttattttttttgtagtttttagagtagtttagtttagtttttagtgttagtaaagaatgttttaagaaagattaagtttaagatataagaaaagtttgtatgggtttttataaattttgaagtaaaatttttttttggttaggtatagtggtttatattagtaattttattattttgggaggttgaggtgggtagattgtatgagtttaggagtttaagattagtttgggtagtatagtaaaattttatttttaaaataaatataaaaattagttgggtatggtggtatttgtttgtggttttagttatttgggaagttgagatgggaggattatttgagtttaggaaggtttaggttgtagtgaattatgattgtattattgtattttagtttgggtaatagagtgagattttgttttaaaaataaataaataaattaataaatatagttttaaatttaagatttttttttaatatatgatatagtgaaaagggtttagggaaatggtttttaaatttgagtattaaaatgatttgggtagttttttaaattgatgttttgtttttattgtagtttaattaaattagagtgttggggtggaagatgggtgttagtgttttttaaaatttttttggagtttttattgtatagttaagtttgggagtttttggtagggagagaggaatgtttgggtttttattttagtttatttataggtttgtggtgagattttagtggtagtttttttttttttttaggtttagtttttttattttaaaaatgatgtagttatgtagttttgaaattatttttaattttaaattatttatataggatttaagaattagagatatttatgaaatttaattgaattttagaattattggaaggaaaaataatttagattttagagaatagaattagtgttaaatttattataatttttgtaagtttttagatttttatattttgtatattgaattgtaggtaataatataaggtttttaattaggttatatttattatttaatgttatgtggtagaagtatatgtatattaaaataggaatatatatttttttttgtttttttagtttttatatataaaattagttatttattattgtgataagtaggattttttatagataggtatatttaggtaaagttgtattaaatttttatattggagagggtaattatgtatttgatattattgggaatgataataaggtgagaatatattgagtgtttatagagggttgattattaaaaggaaagtatggttttagatgatttatgagttattaattaattatatttttatttaagttatgtgtttattttgtttttattttgatttgtatttgttgttgatttaaaagagtagaggaggagagaatttttttttgttgagtttttgttttatgttggtggattgttagtatgtgatgtgtttttatttgattttatatataaagaaatagttttagtgatgttagttataatagttaggtggtaaaggtgggttttttgaaggtataagaatagtttataggttagtttattaggtttattgggtttgggtttgtggtttagatgattttgtttttagggtttgatatgagaatagaaatgggttaagttattttgtagggtataggagagtaagaattatatatagtttggggttttttgataagttgaattgttggatttttttagagttttttttgaatttgtagtttattttttgttgtattaagtaagttttgtttttttttgttttatagtggtttttttttaaataattgtatttgtttttattatggttaggatggtttttggggaatggtaataagtagaattttttagggtgttggagggatttattattttatttgtttgttttgttattataataaaatattgtaattgggtggttttgattaaagaaatttatttgtttatagttttggagattagaaatgtgaggttaagttattggggaaggtttgtttttttttgagttttttttttttggtttgtagatggttatgtttttgttgttttttatatggtatgtatttttggtatttttttttgtgtttaaatttttttttttgataaggatattagttgtattggattagggtttattttaattattttattttatttaagttatttttttaaaggttgtgtttttattatagttatattttgggatattgggggttagggtttaaattaatgaatttttaggggatgtaattgagtttataagataattttattttaaaaagtttttttattttttgttatagtttgttatagtttttaaaatttaatttgagatttttttgtttatagatgagagtttatgtttttaattaggggatttttgaagtttatttgagttggttatagtggttttttttagtattattttttattttttttaaaattagttttattatttttaatatagtttgaggttatttttttgttttttagaagagttgtagtgttgtttggttgtttttttatttattaatggtgttatatatttttgtttttatttgtataagttaagtgtttattgattttaagttttaggaaattggggtatatttattatgtattgtagttttttggatttttttaaaattttaagtttgaagaattttttatagtgtgaagtgggaagttttgttttatattgagaggaattaggatttgttgtttttatttgtttatttttagggtataggtataaattttggttttataaatattttttttttaaaaagttttttttagagagggtttaaggatattggtattatgtagaatttttttaggaatgatggtgtggagggttttggtttttagggtaagggttttttggagtttagtgtgtagtgttagtgtatgggggttgtgattgtgattggtagtaaggtggttttgttggagttaagtagtagtgtggttttagtgttttatttgaatttgtgttaagaaagtttgtgtttttggttgttagtagaggtttgaattttttaataaatttttttttattttaaatgatttagagtaaattttattgtttgtagttaagaattttgtgatttagatagtgattgtgattta

SEQ ID NO: 719 - DNA, 1278 bp, Artificial Sequence
  chemically treated genomic DNA (Homo sapiens)
ttagataagtgatttttgaggagtttttatttataggaataaagtaattaaaaaaatgtattttagaatttataggtttatgtgagatatgatttttttaaatgaagatttagagtaatgggtaaaaaagaggtatttgtgtgtttgttgattgtttagttagtgaatgtatagtttttgttttatatttaggtattatttttttttgttttttgttgttaaatgttttatttttgggtaattttatgtttgttattgtggatatgttgtggttttttgaatttgtttgtgttgaagtaggatttttttttttgtttttttagtgttttaatattatgtatttaaggttggatatattattatttttaatttgttttatttattgtgttatttgtgattattggtttttggtgatttttattaaggtttttgttatgttttgttataatgattataaaagtaagttttatttataggaaaataagaattataatttttttattggttatgtgaaatttattatttgtaatttgtatagtataaatatagaatagtatattttttaatgtttgtattttgaaggtattttgtttgtgttttttaatttggttgtgttattgttggtgtttaatagtttttttagttatattggaaatttttagaaggtattttttatttgtttgtgtgttttttttagtgtttattagaggtttttgtatagggtaggttttttggagtagttgaaggttatatattttatgagtgggtagtagggttagaagtggtttttgtgttgtttaagtaagatttttttttgttttttgttttttgtatttttggtttgtatgtttttgtggttttttgggggtatattttttggggttgggttagaaggtttgggtggttggttttaggttgttatatatttagggagatgtttttgtttttgggaattttggttttgatttttgtaaattttggtaaatgtgtaatttgattttgtattggtttattttgtttagtagtgaaattttgtattgattattaagattttttggaagaggttttagtgtgagtgttgtttttggtatttgtttttttggttagtttgtggtttggttaagtgatgtaatttttttttttagtttgtgtataggtagtttgggaatagttttatttttattttttagttataaatagggttttgtgatttggttaggggaagaagttgttgttgttttgggtattatagtagaaggtaagttgggggttttttta

SEQ ID NO: 720 - DNA, 1278 bp, Artificial Sequence
  chemically treated genomic DNA (Homo sapiens)
tgagggggtttttggtttattttttgttgtagtatttagaataatggtagtttttttttttggttgggttatgaggttttatttatagttgaggggtggggatggagttgtttttaggttgtttgtgtataggttggagaggagggttatattatttggttagattataggttggttagaaggatagatgttagaagtgatatttatgttgggattttttttaggaagttttagtgattgatgtagagttttattgttgaatagagtgagttggtgtagggttgagttatatatttattgaagtttgtaggagttggggttaaggtttttagaaatgggagtatttttttaggtgtgtgatagtttgaggttaattatttaggttttttgatttagttttgggagatgtatttttaagaggttatagggatatgtaggttggaggtgtagagggtagagggtaggggagagttttgtttaggtaatatgggggttatttttgattttgttgtttgtttatgggatgtgtgatttttagttgttttaaagagtttattttgtgtaaaggtttttaatagatattggggaaaatatataagtaagtgaaaagtgttttttggaagtttttagtgtagttggggagattgttaaatattaataatagtatagttagattgaaagatataaataaaatgtttttaggatgtaggtattgaaagatgtgttgttttgtgtttatgttgtataaattgtaaatggtaagttttatatgattagtaaaagggttataatttttatttttttataggtaagatttgtttttgtagttgttataatagggtatgatagagattttggtgagagttgttagaagttagtgattataagtgatgtagtgggtgaggtaggttgggagtggtgatgtgtttagttttaaatatatggtattagggtattgaagggataggaaggaagattttgttttaatataagtaggtttaaggagttatggtatatttatgatggtagatatgaaattatttaggaatggaatatttaataataaagagtaggaagagatggtgtttggatatgaggtagaagttgtatatttattgattgaataattaataaatatataaatattttttttttatttattattttaaatttttatttaaaaaaattatattttatatgggtttgtaaattttgaaatatatttttttaattattttgtttttatagatagggattttttaaaaattatttgtttgg

SEQ ID NO: 721 - DNA, 7467 bp, Artificial Sequence
  chemically treated genomic DNA (Homo sapiens)
atggaatttgataaagtatggtttttttatttatttttattggtttaataagtttttttaaattaattagtttggaaagtgaattttatattttggtatgaattattaggttattttatttatgataaataggttagaggggattttatagtgttttttggaaattgttttatttttttttttggaggtagtattttatggtaggaaatttttggttttggaaagtagatgggttgtgtgttaatgtttatttttagatatattatttagtttttttaagttttagtttttttatttgtaatttttttttttttttggtgaaatgagattttatgtatagtttttattttttatttttttatttttttgttttttttttttttgtgtaaataagatgtgggataggtttatggtggtttatgtttgtaattttggtattttgagaggttgaggtgggagggttgtttgaggttagaagtttaaaatgagtttaggtaatgtatagagattttgtttttataaaataatgtttttaaaaattagttgggtgtggtggtatgtgtttgtatttttagttatttgggaggagtgttgtattttagataatagagtaaaattttgttaagaaaaagaaagaaagaaaaaaaaagaaaagagaagagaaaagaaaagaaagaaagggaatatataaaaggtaaatggtaaaaggttttaggggaaaaggagtttgtagaataagaattagggggattaggagtgagtgataatggggaggttagtgattttgagttatagttttagttttgttttgtataaattgagatttttatttttaaaatggattggtagttttgtaggggtttataaggattataagagataattatgtgatttatttagtatataaaaggtatttttttataaatagtagttattataaggtaatttaagatatttattttttttttattttgttatttattttgtttttaaagtaaattttaattaattttttttaaaatattatttttttttttgttattatttttttttttttgaatatttttatttttttgtttatttatatgttttgtagttaagttagaggagggaaaatagagtaaaagaaaatattaaaggaagtaagtttaaattaataattttgagaaaaatatttaagttttaatattgtgtgtgtgagtgtgtgtgtgtgtgatagagagaaagagagtgagtgagtgagggagagagatagagagagaaggagagagaaagtttttgttaaattgggtaattttaaattttaggaaagtagaaatgggaatttttataaaagtatgatatattagtagaatggaaagaaattattaggtttaaatttgagtgtgtgattatggtttttagttttttgggattgtatgtttgtatgtttgagtttgggaagaggaaagaggaaggattaaaaaaaagaaaaaagaagaagaaaaaaagtattgtggtttaatagtttttttttatttttttaaaggttggtttataatataattagtgttgttagtggggatggtggggatatttttggttttagatgagtgttgggaaggaggggatttgttttgagtgtaagtttgtgtggaagtgtggttggatttgggttttgaatttgggggtttggggttttgtatttaggtgttagtttttttatttgtagagtggtttttagaagtttttgggtggttgtgaggatgttttaaattttgggggttaaggttgagtttggtgttttgtgtttagtttgtgggagtttttggggattggagtgtggttgatttttgttagtttatgggtgattgggattgtggtgtttgtaggtttttgggagtattttgtgaggtttgtttagtttttgttgtttgtttttttgtattttatgtgattttttgatggttttagggattgttttttttgagttaggttttgtttttttggtggttttggagtgtgggtgtagtagttgtgttttgatttttgggagtgttatggtagagttgtgttttttggttgaggagttgttgtgttttatttgtttggagttttttaaggagttggttattattttgtgtggttataatttttgtgggttgtgtttgaatgagatgtgggtagtttagggtttgttatatttgtgtttgtagtgttgtgttgtttattaggtgtgattgtagttgtataagaatatggtgttgtgtaatgtggtggagtagtttttgtaggttgatttggtttgggagttatttgttgatgtttggatgttgtttgtttgtgtttttgtatttagtttgaatgtttaggtggtttgtgattattgtttgaaggaggttgttgtgaagatgtgtttggtgtgtatggtttttttttgttaggagtatttgtagttgtattttgatagttttgttttttaggattatttgttgtagttgtttgtttgtgatttgttgtgttgtaaatgtttttagtataattggttgtgggaatttttttgttttgagtatagtgagtgtatttgttatatttgtttggtggagtataagatttgtttttttgtgtttttgagttaggttagtgttgatttggaggtagggaatggtttgttgggtgtagagggtagtttggtttgatgggtggtgtagaggggttattgggggtttttttgttatattttggatgttttggggagatgggtttgaatttgaggttggggtatttttaatgttagagtagaaaggggatgggagattatatagtttttttttattatttatgaagataggttaggttgtttgttataattttgttattgtttgatggtgtttatttttatttttttgagatagggttttgttttttttatttaagttggagtgtagtggtggaattatagtttattgtagttttgattttttgggtttaagggatttttttattttagttttaagagtagttgggattatagttttttaagtagttgggattataggtttgttaattttttgtagagatgaggttttgttatgttgtttaggttggttttgaatttttgagtttaagtgatttgtttattttgattttttaaagtgttaggaggtttttaaaggtgtgtattattgtgttttattatttgatggtgtttagtagagggttttgaatgttaattatgaatgttggaggttatttttgtttttttatgaagttttggtggtatttaggaggtggatatgatttagttttattttattgttgaggatattgaggtttagagaaatgaatttagtttgatttaatgtagtaaatagttatgtaggtattgtgatttgggttggtttgattttatagtttgtatttttttttatggattagttttgtatttaggtttgtagagtttggagtattaaatagtttaggaagtttgaggttatgtaagtaaaagtttttggtgggttggagagtttttgtgattaggaagggttgttattagaggtttaagagggagggtgggtagtgttttagtaattattggattagagttatagggagagttaatatttttgtattatagtgttttttgttttggttgtgtgattttgagtatggggtttggtttttggatttgggtttttattagtatagtgaggttgtgggattaggtggatttttaagggttttttaggtttgtaatgtttttaggtggtttggggattatattttttttttgtggttttaaagtagaggttgaaattaaattattttttgttatattagtttaagatttaaagtatggtttgattttattttatttttatagtatttttagggagaataagatttgtttttgtgttgttagaggagatagtagtttgagtaaggttagagttgggggtttgtatttagttttgtgtagtatataaatttggttttttttttttttttttttagagatagggttttgttatgttgtttaggatgtttttgaatttttggttttaagggatttttttattttagttttttgagtagttgggattataggtgtgttattgtgtttggttttaaatttggtttttttttttttttttttagagataggattttattttgttatttaggttggagtatagtggggtgattatagtttattgtaattttaaatttttgggtttaggtgatttatttgttttagttttttgagtaggtagtattataaatgtgagttattatatttggttaagttttaaaaaatttttttgtaaagatgggattttattatgttgtttaggttggttttgaatttttggttttaattttttttttattttagttttttgagtagttggaattataggtgtgttattatggggtttggttataaaattagaattttttttttttttttgagttggagttttgttttgttgttaggttggagtgtagtggtgtggttttggtttattgtaatttttattttttgagtttaagtgatttttttgttttaattttttgagtagttgggattataggtttgtgttattatgtttagttaatttttgtatttttagtagagattgagttttattatgttggttaggttggttttgaatttttgtttttgtgatttatttgttttggttttttaaagtgttgggattataagtgtgagttattatgtttggtttatatatatatattttttaatttttttttttagagataggtttttatttagttatttaggttggattatagtagtatgattatagtttattataattttaaattttggatttaggtgatttttttgttttagttttttgagtagttaggattataagtatgtattattatatttagttaatattttaaaatattttttgtagagatgggattttattatgttgtttaggttggttttgaatttttaattttaagggatttttttattttagttttttgaagtgttgggattataggtgtgagttaggagtttggtttaaattttgttgtttaattttaataataggtttttttttgttaatatttatttttttgttttgatttgttgagttttataataggtttgttttttgagttttgttattgttgtttattattgttggtagagttagttttagttgggtaatgtttttagttttaggggttgggttgttttggttattggtgggggtggatttgagattttggtgttttttatgtggaagatttaagtttttagtttgtgaagggatttttaggattttaaaaagttttttgtttttgattaggggattattgttgttattaaagtttttgggttatttttttttggtttggagttgtgtgggtattatttatgatgagggtattgttgtatgtgtttgattaatggtgtattaaattttttaaaatatagggtttagggtgtagtgttatgagtagtttttgaaagtgaagtagttggtagttttggggtgttttgaggtttttttttgttttgaggttagtaaggttggatgtatgtaggtttggtttttggtttatattttattttggttattgttagaggttaggttgaagggtagtgttatagaggttaagtttgaaatattatgagtagtttgggttttttggattgagttagtgtggttttggtttttgtttttaatttttatatgtgattgttattgggttgtttaaatttagatttaagattaggttttgtttagaatattttgggtggagttgaagagtttgggaagtggaagagagagttagagtatgttgagtttgttagttatgggaaggaaattttttttttttagaaatttttagtatgtttagtttgggtatgtgtttatgattttaatattgggattttagttgtgttagttattagtagtgtagttggggtaagttatttaattgttttgtgttttagtgtttttgtttgtaaaggttgggtaatttttattttatagtgttgtttttagttttaagtaagttaatataggtaaagtattagaatagtgtttggtatatagtaagtgtataataaatattggttgttgttgttatggtggtggtgatttttttttttatttttgtgtagtatttatttgagtagggaggtaggagatttagatattgattatgaaaattaattgaaattagatgaggatattagttttttttatatatagtttgtttttgtttttggaggtggttaggattgagtagatttgtatttgggttttagtttttgtgagttattttattttttttttttttttttttgagatagggttttattttgttatttaggttggagtgtagtgatgttattttagtttattgtaggtttaattttttggatttaagtgatttttttgttttagttttttaagtagttgggattataggtgtgtattattatatttggttaatttttgtatttttagtagagatagggttttgttatgttgtttaagttggttttgaatttttgagtgtaaatgatttatttgtttgggttttttaaagtgttaggattataggtatgagttattgtgtttggttggttgatttattttatttttagtttttggtggttttagtttgtagtgagttttggattttgatttttgtttttttgttttgtgaggttgataaaggtttttagttttgttttgggattggtagatgtttttggagagaatattttagatattaggtttatttttttgggtttttttttttttttttttggattttgattttttaattttttgtttgattggttttttagtattttttagtagatttttttgttgttttattatttggattgtttttttggttgtttgtagtgggaggattggtttgagtggttttatttgttattattgaagtagttgttttagtttgttttgtttttgtgtgagtttggttatttttttgttttttttgtttgagttttattggttgtaaaatgggtaattagagaaaaatttataataatataagttggtatttagtatgttttttttaagatttaggtattgggttgagtatttatattgttttaattaatttttttaatagttttgtgagttggggatagttgtatttattttgtgtttaagaaaattgaggtgaaggatatagttgtatagttgggagttgggattggaattttggtttgtattgttttttgaaaaggatgaagggaagtagtaagtattagaatgttttaaaaagttttaagtaggtaagatttgggtgataggatttggggtggtaagatttgggtggagtggaagaggaaggaatttattttgtgggatagttttagggatggtttttggtggggttgggttgaagaggtgtatttttaattttatttgttttttttgtagg

SEQ ID NO: 722 - DNA, 7467 bp, Artificial Sequence
  chemically treated genomic DNA (Homo sapiens)
tttgtagggaaaataaatgaggttgagaatgtatttttttagtttagttttattagaagttatttttggaattattttataggatagattttttttttttttattttatttaagttttgttattttaagttttgttatttgagttttgtttgtttggagttttttgaagtattttaatatttattatttttttttattttttttagaggatagtatagattagggttttagttttaatttttagttgtgtaattgtgttttttattttagtttttttggatataaaatagatataattgtttttagtttatagggttattgggaggattaattgaaataatgtaagtatttagtttaatgtttggattttaggaaaaatatattaaatgttagtttatattattatgagtttttttttaattatttattttatagttaatgaaatttaagtaaggaggatagaaaggtggttaagtttatataggaatagaatgagttgggatagttgttttggtaatggtaggtggggttatttagattaatttttttattgtaaatagttaggaaagtagtttaaataatggggtagtggggagatttgttaaaagatgttggagagttaattaagtagaggattaagaagttaaggtttaggagaagggggaagggggtttagagagataagtttgatatttaggatgttttttttagaggtatttgttaattttagaataaggttgggagtttttgttagttttatagggtagggagatagaaattagagtttaaggtttattgtagattgggattattaagggttgggaataagatgaattagttagttaggtgtagtggtttatgtttgtaattttagtattttaggaggtttaggtaggtggattatttgtgtttaggagtttgagattagtttgggtaatatggtaaaattttgtttttattaaaaatataaaaattagttaggtgtggtggtgtatatttgtagttttagttatttagggggttgaggtaggaggattgtttgaatttaggaggttgagtttgtagtgagttgagatggtattattgtattttagtttgggtgataaagtgagattttgttttaaaaaaaaaaaaaaaaaagatgaagtagtttataggggttgaagtttaggtgtaaatttgtttagttttagttatttttagaaataaaggtaaattgtatatgaaggaagttaatatttttatttgattttaattaatttttataattaatatttgagttttttatttttttgtttagatgaatattgtatagaaatgggaaggaaaattattattattataatagtagtagttagtatttattatgtatttattgtatgttaggtattgttttagtgttttatttgtattaatttatttaaagttaagaataatattatgaggtaggaattatttagtttttatagataaggatattgaggtatagaataattaagtgatttgttttagttatattattagtaattggtatagttaagattttgatattaaaattatagatatatgtttaaattgagtatgttggagatttttagaaaaaaaaaattttttttttgtaattagtaggtttaatatattttggtttttttttttattttttagattttttaattttatttaagatattttgggtggaatttgattttgaatttagatttgaataatttagtgatagttatatgtaggggttggaggtagggattaaggttatattaatttaatttgaaaagtttaagttgtttatgatgttttaaatttgatttttgtgatattgttttttgatttggtttttaatagtggttaagataaggtgtgggttaaagattaggtttatatatatttggttttgttggttttagagtaagaagagattttagaatattttaaggttgttaattgttttatttttaagagttgtttatagtattatattttgagttttatattttgaaagatttgatatattattaattaaatatatgtggtagtatttttattatgaatggtgtttatatgattttagattaaaggaaagtgatttaaaaattttggtagtagtaataattttttaattaaaggtaaaggattttttgaaattttgaggatttttttatagattagagatttgggttttttatatgggaggtattagagttttaagtttgtttttattagtggttaaggtaatttagtttttgaggttaagggtattgtttagttgagattggttttgttaatagtgatgagtagtagtaatagggtttaaaaagtagatttgttataggatttagtaagttaggataggggggtaggtgttggtagaggaaggtttgttgttaggattaaatagtagagtttaggttaggtttttggtttatgtttgtaattttagtattttaggaggttgaagtgggaggattttttgaggttgggagtttaagattagtttggataatatagtgagattttgtttttataaaaaatgttttaaaatattagttgggtgtggtggtgtgtgtttgtagttttagttatttaggaggttgaggtaggaggattatttgagtttagggtttaaggttatagtgagttatgattatgttattgtagtttagtttgggtgattgagtgaaaatttgtttttaaaagaaaagattaaaaaatatatatatatgggttgggtgtggtggtttatgtttgtaattttagtattttgggaggttgaggtgggtggattataagggtaggaatttgagattagtttggttaatatggtgaaatttagtttttattaaaaatataaaaattagttgggtatggtggtgtaggtttgtagttttagttgtttgggaggttgaggtaggagaattgtttgaatttgggaggtggaggttgtagtgagttgagattgtattattgtattttagtttggtgatagaataagattttaatttaaaaaaaaaaaaaaaattttgattttatagttaggttttgtggtagtatatttgtagttttagttatttaggaggttaagatgggagaaggattgaggttaggagtttaagattagtttgagtaatatagtgagattttatttttataaaagaattttttaaaatttagttaggtgtggtggtttatatttgtagtattatttatttaggaggttgaggtaagtggattatttgagtttaggagtttgagattatagtgagttatgattattttattgtattttagtttgggtgatagagtaagattttgtttttaaaagaagaaaaaaaaaagttaagtttagagttaggtatggtggtatatttgtagttttagttatttaggaggttgagatgggaggattttttgaggttggaagtttaagaatattttaggtaatatagtaagattttgtttttaaaagaaaagaaaaaaaaagttaagtttatatgttatataaagttggatgtagatttttaattttgattttgtttaggttattgttttttttgataatatgaagatgggttttgttttttttgaaggtgttgtgagaatgaaatgaaattaggttatgttttggattttaggttgatgtaataaaaggtggtttgattttagtttttgttttgaggttataaggggaaggtatgatttttaaattatttaaaaatattgtagatttgaaaggtttttaggaatttatttagttttatagttttattatattggtgaggatttaggtttaggggttaaattttatgtttaaagttatatggttaggatggaggatattatggtgtaagagtgttggttttttttgtggttttgatttagtgattattgggatgttgtttatttttttttttaggtttttaataataattttttttgattataggaattttttggtttattaaaggtttttgtttatatgattttaagttttttggattgtttggtgttttggattttatggatttggatatgaggttggtttatgggaagaaatgtaaattatgaaattgaattaatttgggttataatgtttgtgtggttatttattgtattaggttaggttaagtttatttttttggattttagtatttttaatagtaaaatgaaattaaattatatttattttttgggtgttattaggattttgtgagggaatagaggtaatttttaatgtttatagttgatatttaaaattttttattaaatattattagatggtggggtgtagtggtgtatgtttttaaagattttttagtattttaggaggttgaggtgggtagattgtttgagtttaggaatttgagattagtttgggtaatatggtgaaattttatttttataaaaaattagtgagtttgtggttttagttatttgggaggttgtggttttagttatttttgaggttgaggtaggaggattttttaagtttgggaagttgaggttgtagtgagttgtgattttgttattgtattttagtttgggtgagagggatgagattttgttttaaaaaaataaaaataaatattattagataatgataggattatggtaagtaatttaatttgtttttatggatgatgggaagggattatataattttttattttttttttattttgatattggagatgttttggttttgaatttaggtttatttttttagggtgtttagagtgtggtagagaggtttttggtggtttttttgtattatttattaggttaggttgttttttgtatttagtaggttgttttttatttttaggttggtgttggtttggtttagggatgtgggagagtaggttttatgttttattaggtagatgtggtagatgtatttgttgtgtttggggtagaaaaatttttgtagttgattgtgttgggaatatttgtggtgtaataggttgtgaatgggtggttgtagtgggtggttttggaaggtggggttgttgaagtgtggttgtaggtgtttttgatagaaggaggttatgtatattaagtatgtttttatggtggttttttttaggtagtggttgtaggttatttgggtatttgggttgggtgtagaggtgtgggtgggtggtgtttagatgttggtgggtggtttttgggttaggttggtttgtaggaattgttttattatgttgtatagtattgtgtttttgtgtagttgtggttgtgtttggtagatggtgtggtattgtgggtataggtatggtgagttttggattgtttatgttttatttaggtatgatttgtagaagttgtggttgtatggagtggtgattggttttttgaagggttttaggtagatggagtatgatagttttttggttagggggtatagttttgttatggtgtttttaggggttgggatataattgttgtatttgtgttttgaggttgttgaggaaatgaaatttagtttgagaggagtagtttttgaagttgttaggaagttatgtggggtgtgggggggtgggtggtgaggattgggtgggttttgtgaggtatttttgggagtttgtgggtattgtagttttagttgtttatgagttggtgaaggttggttgtgttttgatttttaagagtttttgtgggttgggtgtgggatgttgggtttggttttagtttttgggatttagagtatttttgtgattatttggaggtttttgggggttattttgtggatgaggaagttgatgtttgggtgtagaattttggatttttggatttagagtttaggtttagttgtgtttttgtataaatttgtgtttggagtaagtttttttttttttagtatttatttgagattagaggtgtttttattgtttttgttagtagtgttggttatattgtgggttaatttttaaaaaaataaaaaggaattgttaaattatagtgttttttttttttttttttttttttttttttaatttttttttttttttttttttggatttggatatgtggatatataattttggaagattggaggttgtagttatatatttaaatttaaatttggtgatttttttttattttattgatgtattatgtttttataaaaatttttatttttatttttttgggatttggagttatttagtttaataaaggttttttttttttttttttttttgttttttttttttgtttgtttgttttttttttttttgttgtgtgtgtgtatatttatatatataatattggaatttaaatattttttttaaagttattgatttaaatttattttttttaatatttttttttgttttgtttttttttttttggtttgattgtaggatatatgggtggataggagagtagaagtgtttaaaagaggggggatggtggtaaagagaaggatggtgttttggaaggagttagttggagtttgttttggggatagagtgagtagtaaaatgaggaaaaggtaaatgttttagattattttgtaatagttattatttatgggggggtattttttgtgtgttagataagttatatggttattttttataatttttataaatttttgtaagattgttagtttattttaggaatgagagttttaatttatgtaaagtaggattgggattgtagtttaggattgttgatttttttattgttatttatttttggtttttttaatttttgttttgtagatttttttttttttaaaattttttattatttattttttatgtatttttttttttttttttttttttttttttttttttttttttttttttttttttttttttttgataaggttttgttttgttgtttagggtgtggtattttttttaagtagttgggaatataagtatgtgttattatatttagttaatttttgaaaatattgttttgtagagataaggtttttgtatgttgtttgggtttattttgaatttttgattttaagtaatttttttattttagttttttaaagtgttaaaattataggtatgagttattatgggtttgttttatattttgtttgtatagagaggaggaagatagaagaatgaggggataggaaatgaaagttatgtatagaattttattttattaaaaaaaaaaaaaaattatagatgagaaaattgaggtttagagaaattaaatagtgtgtttaagaatggatattggtatatagtttatttgttttttaaagttaggagttttttattataaaatgttgtttttaaagggaggagtggagtagtttttaggaaatattgtgaaattttttttgatttatttattatgggtgaggtggtttagtgatttatgttagaatgtggaatttattttttaggttggttggtttagaagggtttgttagattaatgaggatgaataggagggttatattttattaaattttat

SEQ ID NO: 723 - DNA, 11021 bp, Artificial Sequence
  chemically treated genomic DNA (Homo sapiens)
atttttgtttaggggttatgttttgtagttttttttttttaaggagttagaggtttttaagtttatgttttgattgtgtgttatgggttgaattgtgttttttttttttataaatgtgtatgttgaaatttttgtttttaatattttagatgtgattgtatttggggagaaagtttttaaataggtaattgagggtgggttttaatttagttttattggtgtttttataagaagaggagattaggatatagatatgtataaagggaagattatgtgaagatataggagaagttatttgtaagttaaggagagaggttttagaagaaagtatttttgttagtgatttgatttagtttttagaattgtgaggaaatgagtttttgttgttgaagttaattagtgtatggttttttgttatggtagttttggtaagtttatatattatgtgttttattgtgtttgtgttgttgtaaaggaatatttgagggggtgggggtaatgtataaagaaaatagattttttggtttatggttttgtaggttgtataagaagtatggtgttggtatttgtttttggtgagggttttaggttgtttttatttatagtggaaggggtaggggagttggagtgggtaggttatatggagagagaggaattaagagagggggtggtgttaggtttttttttaataattagattttgtggtagttaatattgatagaatgagaatttatttattattgtggggatggtattgagttgtttatgagggatttatttttatgatttaaatattttttattaggttttatttttagtattggggattaaattttagtatgaggtttgtgggaataagtgttttaattataatattatgtttaggaatgttttgttaagtgggtaaaagggttgttaatttgaagggagtattttgtggaaggagataagttttttttgatttttttgatttttattgagtatttatgtgatgtttatttttatgagtgtgatggatattattggaatgtttaggaagatgatatggaaaagttagtattagaagtatgtattttggttgggtatagtggtttatgtttgtaattttagtatattgggaagtttaggtaggtagattatttgaggttaagggtttgagattagtttggttaatatggtgaaatattgtttttattaataatataaaaatgagttaggtgtggtggtgggtgtttgtaattttagttatttaggaggttgaggtagaagaattataaatttaggaggtggaggttgtagtgagttaagattttatattgtattttagtttgggtgatagagtgagattgtgttttaaaaaaaaaaaaaaaaaaaaaaaaaaggtgggtattgtggtttatttgtaattttagtattttgggaggttgaggtgggtggattatgagattaggggtttaagattagtttggttaagatggtgaaattttgtttttattaaaaatataaaaaaaaaaaaaagaaattagttgggtatggtggtaggtgtttgtaattttagttatttgggaggttgaggtaggagaattatttgaatttggagggtggaggttgtagtgagttgagattatattattgtattttagtttgggtgatagagtgagattttgttttaaaaaaaaaaaaaaagaaaagaaaagaaatatgtattttatttttagttgttttatgtttagttttatgagatgggagtagatgaatggttgttttggtgttgaagtttttatattttatttttttttaaaaatgaaaataaaaaaaaatgttgtttgttagattatataaagttatataggtttataatagagtttaggaattttttgttttttttagagtaggtatagagatatgtggtttttagtagagtttatggggtttagatgatttatataagaatagaagttttagggttggatttggggaggtagtttgagtttgagttggttgttttgagtttgagtattttagttgttttgttgttattgtatttggttgttatttagtgttagtatatagtaatgagtggttgagttttttttgggagggaggaaatagttaaaattttgtagtagttgtaattatttaggtgtggtttttttgtttgatttgggttgtatagattttgggttaagggatagaagaaagatagtttaggagtagagttttttagatggttgagttggatttaatggttttagggttattgtttagggttattgtttagtttttagttttttttagtttagattttgggttatttagtttagattttgggttagttagtttagtggaagaagaggatgtgggttttttggagaagtttggtagggagatggaggaataggatagtgattttgtagagtagggggattttgttggtgaggggaaagaggttttgtgtgatttttgttttgatgatattagaagagtgaaggtagtgaagttttgtttaatttgtatggtgaattattgtgaagagtatttgtagttgtattaggtgaatattaaattgtaaagttatttgttgattgagttagtgaaggattataattggtgatattgttttgtttattatagtttattgtttgttttttgttgttttgattagtagtgtatttgttaggattgttgttaggagtatagtggttatattatagtttttttggatgtagtttgtagggataaggaggtgagtgtttggggattatttatttatttgggagagggtggtgggggatggtgtgtttagttggttgtagttgttaggtttattgatgttattattatgttttgagtatatttgaaaaagattagttttagtgtttgtttgttgggttagtgtaaatatatattgtatttggttttggaaattgtgtggagtaggttgttttgtttttatttttgttttattgtttttgtgtgatttttgtttgtgtttgtttttttttttttttgttagttttttgttgtgttttatatagtttttggtgatgtgtgtttgggtggagggtgtagaagttgtgggggtttagggtggtgatatgtttttgtggttggatttgtatggtatatttattgttaattaatgaaataaaattttggtagaaatttaagagaaaagaataatttttttttttagttttttttttttttaaataagagattagtagaatgggtttttttggagataataggaaatttaagagtttgaaaagtgttaagatagtagagaatttgaaatttaggtttaggtataatgttataggtggtttagggataataaaagttttttattagatggaggtattaggagagattaagaaatattatgtttatagtttgttattttatttttattggataaggaaattgtttttagaataagttgtttttttttgtttaaagttagattttggagaagtttttggaaattggtttggtattttatatgtttttttttttttattttgatttttagtgaatatttttagtttttagttgggaagtgtagttgatgtttgttttatattttttatattaattattaaggaagttttttgttgatattgagtgtaggtggtagatttatggttattttttggtaaatgttttttggtattaaaggaaagaggtttttaggaaagggggtttatttgttagggttttttttttttgttaatttttagatatagattttagttggtgttagtgggattgttttggaaatttttgtattttagatgttaatgagttattgtttttggtttgggaagttatttgttaaattgtttttagtgtttttagggtagggagtgttttattaggaggataggtagattaagaaatagattaaaggaaaaagtttttgtagttgaggaaaatagtttttattgagtattgttatgtgttgaatgttttttgtggatttttttatttaatttttaaataattatgaagttattttatatttttattatttttattatatttgtttaagtttatagttgattaagttatggagtgaggaatggaagtttttggaaagttattttattggagggatatgaagaaaggatataaaaattataatattattttttttttttgtattaaaatttgttatatatatataagaattttattatttttaattggaaaagtgatgtatgaagatgttaaaaaataatttttattagttgggtatggtgattgatatttgtaattttagtattttgggaggttgaggtaggtagattatgagggtaggagattgagattattttggttaatatggtgaaattttgtttttattaaaaatataaaaaattagttgggtgtggtggtgggtgattgtagttttagttgttagggaggttgtagtaggagaattatttgaatttgggaggtggaggttgtagtgagttgagattgtgttattttattttagtttggtgatagagtgagattttattttaaataataataataatttttattaaatagtgtaattaattttattaggaaaggagggtttttagtttattttagattattaaatttttgttttttttttgaaggttaatattgtttatatttttttatttttttgtagaaatgttttatgtttgtattaatagagatataatataaattttaaaaatagggtatttaatgtattagagagatgtggggtaattgtaattttaagtaggaggagttgtgtagagtatgtgtagaattttgaatttagatattttaggagagaagtgtataaggtaaaatgaggataattgaggaatgggtttgagggtagtttggggttgaaaagtaatatggttttaggtatagtgttaaaattttattttttagatttttttgttttttggtttgtttaaaagagtttttgttttttttgtgtttttgttttgtgtttttgtttttagtttggagagtaagtttattttgtaagtgtagttatattttaggtggtttgtttaaattttagaagttaaaaggttttttgtagggagtttaggagattagtttagaagatatagtattttgatgaggttaaagtttttattaggatgattttgaaagttattagatataattaaggttttggaagtttagtagtttttttagttagtttaggtttgttagagttatttgttgaaggttattttgggttatgtgaagggttaattatttggataggtatgttgtgtataggaaattgtaaatagtagggttagttatgaagatataaagtggttgagattttgtttaggatttatagaatgattaattttttagttaattaagtgaattttttttgaagtttttatggtttttagttatattagtgggtagatattgtgtgttttgagaggtgggtgttttttgattatttttttttttttgttgagtttttagagtttagttattttttatggggattttagtatttttttttattttagattagtatttttaggtttttttgtgtttttttgtttgtttgtttgtttgttttttgtttttttttttttttgagatggagttttgttttgttatttaggttggagtgtagtggtgtaattttggtttattgtaagttttgttttttgggtttatgttatttttttgttttagttttttgagtagttgggattataggtgtttgttattatgtttggttaatttttttgtatatttaatagagatggggttttattgtgttagttaggatggttttgattttttgatttggtgatttttttgttttggttttttaaagtgttgggattataggtgtgagttattatgtttggttttttttggttttaagagtagttgattttgtttgttggttgttaagtttttttattttttttgaattttaggtttgttatgtagaaatgagattgtgtgtgtgtgtgtgtgtgtgtgtgtgtgtgtgtatgaaatttggattttttttatgattgttttttttgtttgttttgatttatgaagtaggtatggtttttttatgttttttaagtgtattaaatgttattgagtgttttttattgttaagtgttgggttgtattgtttagtttttaggagtttggattttaattaggaagttaaggtatatattttaattttatagagtgttaagaggttggtatggtgtaattattgtatttttggaattaattttgggagtgaggttagtgtaggtttttaaggtaggaagatttgagttgagttttgttttagatttttggagaatattaatgttaggttatgatgttgaattttagtattagttttagaaagtttaggattggatgttggttgtagatatagtttttatggtgagtaagagttaagtatttagagttaaaagtatttatgtttatttggggagtggttaattggtattatttatagtttgtttgttggtagttgaaaggtggatgataggtgtatgtggttatttgggaaaggaattatttgggttgggtgtggtggtttatgtttgtaattttagtattttggtaggttgaggtgggtggattatttgaggttaggagtttgagattagtttgatttatggtgaaattttgtttttattaaaaaaaaaaaatataaaaattagtttggtatagtagtaggtgtttataattttaattatttaggaggttgaggtaggagaattgtttgaatttgggaggtggaggttgtagtgaattgagattgtgttattgtattttagtttgggtgatagagtaagattttattttaaaaaaaaaaaaaaagaatttattttagttattttggggaatgtttaggatttagtattatgtaatttgttttttttatttttttaggttgtaagtattttgagagggggtagtgtgtgttttatgtgattgagttggttatatgtattatggtgaattttgagtagttgattgaggtatgtagttagtgtttaggtggattttagtttttttttttttagaaaggttaattttgtgtgtttggaatataaaggaattggtatagtttgggatttttttttttttttttattttttttgttttttttattttttatttttaatatgatttggttgttattttttgtgtgttatttttgttttgtagtagaaggaatttttttgttagtatatttaggtagttttgtattagatgagaagttaaatggtttgaatgatttgataaagtttatatggttagtaagtggtaggttttaaaatattttggattttaaatagtgtgtttttgatatatttgttattgttttgttgaagtaggtagagttttgtgtgttttgttttttagaattttttgtgtttatgggtattatagttttgtttttgggtagggtttattttgatttgagatgtgtgtgtggttgattttttgggaaattttgaagttagtgtttgaggtattttattatttttaaggaataggaataattggagaaataagttttttaaagtggttttattttttgaggtaattgggagtgtttttttttggggtgatttagttaggaaagtttttgattatgtatttaaggagtttttttttttttttttatggtagtttgtaaatagtagagagaagttttttatttttgatgttttttgggtatttttttatggttttgttgttgttgattgttttaatatatttttttgtttttgttgtttagatgttgtgttgtaggagtttgttgttagggtgtgttttgatgtgttttttattatttttaaataagtagtttatgtttttttttttttttttggaatgggttattgtgtaagttttttttatagtttaagattttaggattgtttttaaataggttagatttatttttattttttatttttaggtattatgttttaggtattaagggtgagaggttattggggtttttttagttttatttttagtgatttggagtttgagtaaatattttttgttttttgtagtgttttggagaggtgagttttttgtttgtagttgtttttttttttagggggtttggaatttttttagtttttagtggagaatggagagatagtttatgttttttgagttttattagggtataatgatttgtagttttaaatgtagatagaagttattaagtagtgaaagtgatttttttttttttttttttttttttttgtatattgtttttgtggaagtaggaaagtgatagggtttttgaggtttgtaaaggtttaagtgtgttttggtatattttttggtagaaggtgtttagtgtattttaggaggtaagattgaagttggggttaaagtaggtaaatttgaggtttttgggtaggtatttgtttgggttgggagggttggttttgtttttgaatatagaatatgaatggaaagtagttatggtagtaggagtaataatgatgatgatgatgatgttggtatttattgatatttatggagtttattaataatgtttttggtattatataaagtttttattgatatatgttattttgttagtttatttttttttaattttatgaagtaaatattttattgagttttattttataggtgaagaaatggaagtttagagatattaagttgtgaaataagaaataggttaggtatggtggtttatgtttgtaattttaatagtttgggaggttaaggtaggtggattataaggttaggagttttagattagtttggttaatatagtgaaattttgtttttattaaaaatataaaaattaattgggtgtggtggtgtgtatttgtaattttagttatttaggaggttgaggtaggagaattgtatgaatttgggaggtggaggttgtagtgagttaagattgtattattgtattttagtttggatgatagtgtgagattttattttaaaaaataaataaagaataataataataataataaaaatttaggtttggtttttgtttttattttttggtatttgatagtttttagaatttttagattttttgaagtggtaagtgtttgaatgttagtgagatgattgggtggttgagggggtttttgagagttttaggatgggggttagttgttaaaggagttaattttatgatgaaagggtttgatttttagttttatttttttgattttttttagggagggaagtgaggttgaaggttgagaggattattaatggttagtgatgtaattaattatgtttatattatgaagtttttatataaatttaaaaggtattaggtgtggtggtttatatttataattttagtattttgggaggttgaggtggaggtagattatttgaggttaggagtttaagattagtttgattaatatggtgaaattttgtttttattaaaaatataaaaaaattagttaggtgtggtggtatatatttgtagttttagttttttgggaggttgaagtaggagaattgtttgaatttaggagatagaggttgtagtgagttgagattgtgttattgtattttagtttgggagatagagtgagattttattttaaaataaataaagatataaatttaaagggttgggtttttgggagtttttggattgttgaaggggtggaagtttatggagggtgtgtattttgtattggagagggtatggaggtgttattttttttttatattttttgttttgtgtattttttttatttttaagtagggagtgttagaattgagttatattttaggatatttagttgttgttggagaatggttttatgtggaaaaaaatttatatgttttagttatgaaagtgttttgtgttgtgtgattataagataaagaaagtttgttttttttatttataagtaaatttggttaaagttttaattgttaagtaaaaaaatgtagattttttatttggttatttggttttaattttatattttttgtttggtttttgtggggttagtttaggtttaattttattgatgaatttggaaatatgattttattatttgtatttttgaaataataattatgtttatttatgttgataaaaggagttaaattttgtaatatatttgaagatatttattttgagttaaatatgagtgattaatggtttgtgatatagtttttaggagattttgagaatatgtgtttaaggtggttggggtatagtttagtatatattttagggagatatgagatattaattaaatatatgtaagatgtaatttggtttggtttggaaaggtgggataattggaaattagggtttttgggttataggtagatttaaagattttttgattggtagttggttgaaagagttaagttattgtttaaagatttaggaatgtttgggttaagataagaggtggtggaaattaaggttttattatgtgggtaaagtttttagggaggaggttttggagagaatagattgtaaatgtttttaattagattgaaagagtttgttgtattagtaattttaaaagggaggaagttataatgagttatgtttgatttttttttttattatggtttgaattggttttttaggttaattttggaatgttttttgttgagaggagggatttatttagattgttgggggtttaggattttatttttggtttatagttagtatgggtatggtaaggatggtgtggggtaatttataaaatgtttgaaatggtgagtagtatggtatttgtgtttattgtatttttgttgatttatgttgattgtagttttaggagggtatgggtttattgttaattttttgtgttttttggttggtttttgagattagttatagaagttaaatttttttttagggaagaagggtggggatgttagggttggagagtgtttgtgtttttttgtgtgtattgggtttttttttttttaattttttgttttttatttttagg

SEQ ID NO: 724 - DNA, 11021 bp, Artificial Sequence
  chemically treated genomic DNA (Homo sapiens)
tttaaaagtggaaagtagagaattaaggaggaaggagtttaatgtatatagaaggatatgggtattttttagttttgatatttttgttttttttttttggaaagaagtttaatttttgtggttgattttagaaattagttgggaggtatgaagggttggtggtgagtttgtgtttttttggggttgtagttagtatgagttagtgaaaatatagtgagtatggatgttgtgttgtttattattttaagtattttgtggattattttatattatttttgttatatttatattagttgtaaattagaaataaaattttaaatttttaataatttgaatggatttttttttttagtaaagggtattttaaagttaatttgaaaaattagtttaggttatgatgggaagggaggttagatatggtttattataatttttttttttttggaattattgatatagtagatttttttagtttgattagaaatatttataatttgttttttttaaaattttttttttggaggttttatttatatgataaaattttggtttttattattttttattttaatttagatatttttaagtttttagataataatttgatttttttaattaattgttaattagaaaatttttgaatttatttatgatttggaagttttggtttttagttgttttatttttttagattaaattaaattatattttatatgtatttgattgatgttttatgtttttttaaaatgtatattaggttgtattttaattattttgggtatatgtttttagggttttttgagagttgtgttatagattattggttatttatatttggtttaggatgaatatttttaaatatgttatagagtttgattttttttgttaatataggtaaatatgattattattttaaaggtataggtgataaaattatgtttttaagtttattaatggagttgagtttaggttgattttataagagttaaatagggagtgtagggttggagttagatggttaagtgggaagtttatatttttttatttagtagttgagattttggttaaatttatttatgaataggaaaaataaattttttttgttttatagttatataatatagaatatttttataattaaaatgtgtgggtttttttttatatgaagttattttttaataatagttgggtgttttaagatgtaatttaattttgatattttttatttggagatggaagagatgtatggggtaagggatgtgggagggaagtgatatttttgtgttttttttagtgtagggtgtatattttttatggatttttatttttttagtaatttagaagtttttggaagtttagttttttgggtttgtgtttttgtttattttgagatggagttttgttttgttttttaggttggagtgtagtggtgtgattttgatttattgtaatttttgttttttgggtttaagtaatttttttgttttagttttttgaggagttgggattataggtatgtgttattatatttggttaatttttttgtatttttagtagagatagggttttattatgttggttaggttggttttgaatttttgattttaaatgatttgtttttattttggttttttaaaatgttgggattataggtgtgaattattgtgtttgatgttttttgggtttatatggaggttttatgatgtaggtatgattgattatattattggttattggtgatttttttaatttttagttttatttttttttttggaggagattagggagatggggttgaaagttaaatttttttattatagggttggtttttttggtaattagtttttattttgaggtttttgggagtttttttagttatttagttattttattggtatttagatatttattattttagagagtttgggggttttaagagttgttgggtgttaggaaatgggggtagagattaaatttaagtttttgttgttgttgttgttgttttttgtttgttttttgagatggagttttatattgttgtttaggttggagtgtaatggtgtaattttggtttattataatttttattttttgggtttatgtgatttttttgttttagttttttgagtagttgggattatagatatatattgttatatttggttaatttttgtatttttagtagagatagggttttattatgttggttagattggtttggaatttttgattttgtgatttgtttgttttggttttttaaattgttgggattataggtatgagttattgtgtttggtttgttttttattttataatttaatatttttaaatttttatttttttatttgtgagatggggtttagtaaagtgtttgttttataggattaggaaagaatggattaatgagataatgtatgttaataagaattttgtatagtattagggatattattaatgagttttataaatgttagtgggtgttagtattgttattattattattattatttttgttattatggttgttttttatttatgttttgtatttgaaggtagagttagtttttttagtttaggtaagtgtttgtttaaaaattttaggtttgtttgttttggttttagttttaattttgttttttgggatgtattaaatattttttgttaagaggtgtgttaaggtgtatttaagtttttgtaaattttaaagattttgttatttttttatttttataagggtaatatataaaaagaaaaagaaaaaaaaaaaagaattgtttttattgtttaatagtttttgtttgtatttaaagttgtgagttattatgttttaatagaatttagagagtataaattgtttttttattttttattgaagattgggggaattttaggttttttggggagggaagtagttgtaggtagaggatttgtttttttaggatattgtagaaggtaggaaatgtttgtttaggttttaggttattgagagtggagttgagggggttttagtgattttttatttttgatatttgagatgtgatgtttgggagtggggagtgggggtggatttggtttatttgggggtaattttggaattttgaattatgaaaaaggtttatatagtgatttattttaggggagagaaaaggaatatgagttgtttgtttaaaggtggtggaagatatattagaatatattttagtaataggtttttataatatggtatttaaatagtagggatagaagaatgtgttgaagtagttggtagtagtggggttatagggaggtatttagggagtattgagagtgaggggtttttttttgttatttgtagattattataaaaggagagaaaaggattttttaagtatataattggggatttttttgattgagttattttaagaaaaggtatttttagttattttaaaaggtggaattattttgaaagatttgtttttttagttatttttgttttttgaaaatgatggggtgttttagatattggttttagggttttttaagaggttagttatatatatattttaggttagggtgggttttgtttagaagtgggattgtggtgtttatgagtatagaaagttttggaaggtagggtatatagagttttgtttgttttagtaagataatgatagatgtgttaaaggtatattatttggagtttgaaatattttgggatttgttatttgttggttatataggttttgttaagttatttaagttatttagttttttatttggtgtaagattatttaaatatgttaatagaagggttttttttgttatagggtaaaggtggtatataaagagtggtagttaggttatgttagagatgaaaaatagaaagaatagggagagtgggaagagagaagaaaattttagattgtgttagtttttttgtattttaagtatatagggttagtttttttagagaaggaagaattagagtttatttggatgttgattgtatgttttggttagttgtttagaatttattatagtatatatggttagtttagttatataggatatatattgtttttttttaaaatatttatagtttgggagaataagaaaaataagttatgtaatattgagttttgggtattttttaaaatggttgaaataaattttttttttttttttttgagatggagttttgttttgttatttaggttggagtgtaatggtgtgattttggtttattgtaatttttattttttaggtttaagtgatttttttgttttagttttttgagtagttgggattataggtgtttgttattgtgttaggttaatttttgtattttttttttttagtagagataaggttttattatgggttaggttggttttaaatttttgattttaggtgatttatttgttttggtttgttaaagtgttgggattataggtgtgagttattgtgtttggtttaagtaattttttttttaagtggttatatatatttattatttattttttggttgttagtaaataggttgtgagtgatgttagttaattgttttttagatgagtgtggatatttttggttttagatatttggtttttgtttattatggagattgtgtttgtagttagtatttagttttgaattttttgggattgatgttgaggtttagtattgtggtttggtattaatgttttttaaagatttaggataaggtttagtttaggtttttttgttttaggaatttgtattgattttgtttttagggttggttttaaaggtgtagtaattgtattgtgttagttttttggtattttgtggagttagggtatgtgttttggttttttgattagagtttaagtttttggaggttagatagtgtagtttagtatttagtgataggaagtatttagtaatatttgatatgtttgaggaatatgaaagaattatatttgttttatgggttagaataaataggaaaggtagttatagaaggagtttagattttatatatatatatatatatatatatatatatatatatagttttatttttatatagtaagtttgagatttagagaaggtgagaagatttggtagttagtaggtaagattagttgtttttaaaattaaagggggttgggtgtggtggtttatgtttgtaattttagtattttgggaggttgaggtagggggattattaggttaggagattgagattattttggttaatatggtgaaattttatttttattaaatatataaaaaaattagttgggtgtggtggtgagtatttgtagttttagttatttgggaggttgaggtaggagaatggtatgaatttgggaggtagagtttgtagtgagttgagattgtattgttgtattttagtttgggtgatagagtgagattttgttttaaaaaaaaaaaaaaataaaaaataaataaataaataaataaaaaaatataaaggggtttggagatgttggtttggggtaaagggaagtgttgaggtttttatgaaaaatagttgggttttggaagtttagtaggagagaaaagataattaaagaatatttattttttaaagtatatagtgtttgtttattgatatggttagaaattataggagttttaaaaagggtttatttggttaattgagaaattagttattttgtggattttaagtaggattttagttattttgtgtttttatggttgattttgttgtttgtagttttttatatatagtatgtttgtttgagtaattagttttttgtatgatttaaagtgatttttagtgagtaattttagtaggtttgggttagttgaagggattattgggtttttggagttttagttatgtttgatgatttttaaaattattttggtggaggttttagttttgttaaggtattgtgttttttaggttggttttttgggttttttgtaagaaattttttggtttttaagatttggataagttatttagagtgtggttatatttatagagtaaatttgttttttgagttgaaaataaggatataggataaggatatagaaaggataagagtttttttaagtagattagaaagtagaggggtttggggaatggggttttagtattgtatttaaagttatgttgttttttagttttaaattgtttttaagtttattttttagttgtttttattttattttatatattttttttttaggatgtttgaatttagagttttgtgtgtgttttatataattttttttgtttggaattgtaattattttatatttttttaatatattaggtgttttgtttttaaaatttatattgtatttttgttggtataggtatagaatatttttgtaaggaaataagaaagtgtagatagtattagtttttgaggagaaaatggaggtttggtgatttgggatggattggagattttttttttttagtaaaattgattgtattgtttgatggagattattattattatttgagatggagttttgttttgttattaggttggagtgaagtggtatgattttggtttattgtaatttttgttttttaggtttaagtgatttttttattgtagtttttttagtagttgggattatagttgtttgttattatatttagttaattttttgtatttttagtagagatagagttttattgtgttagttaggatggttttgattttttgtttttatgatttgtttgttttggttttttaaagtgttgggattataggtgttagttattgtgtttggttggtggagattattttttaatatttttatgtattatttttttagttaaaaataataaaatttttgtatatgtgtggtaggttttggtgtaaaaaaagaggataatattgtgatttttgtgttttttttttatgtttttttagtaggatggttttttagaggtttttattttttattttgtgatttaattgattatgagtttggataagtgtggtggagataatgaggatatgagataattttatagttatttgaagattgggtgagaaaatttataaaaagtatttagtatatggtaatatttagtgaaggttattttttttaattataggagtttttttttttgatttattttttgatttatttgtttttttgatgggatattttttattttgggaatattggaaatagtttggtaagtggttttttgggttggaaatagtgatttattggtatttggaatatagaggtttttagaataattttattagtattagttaaaatttatgtttagggattggtagagaggaggggttttggtaagtagatttttttttttagaaattttttttttttgatgttagggaatatttgttaagaaatggttataggtttgttatttgtatttagtgttaatagggaatttttttgatgattaatgtaggaaatgtggggtaaatgttaattatattttttgattgaaaattaaaagtgtttgttgaaagttaaagtagaaggaaaaaagtatatgaggtgttaaattaatttttaggaatttttttaggatttagttttaggtaaagaaaaatgatttgttttagaaatagtttttttatttgatggaaataaaatgataggttatgagtatgatgttttttagttttttttgatatttttatttggtgaggaatttttattatttttaagttatttgtgatattatatttggatttaagttttaaattttttgttattttagtattttttaagtttttagattttttgttatttttagaggggtttattttattggttttttgtttgagaaaaagagaaattgggagaaagagttgttttttttttttgaatttttgttaaggttttattttattaattgataatggatgtgttatgtagatttagttatagggatatattattgttttaagtttttataatttttgtattttttatttaaatatatattattaaaagttgtataaggtatagtaggaaattagtaagaaggaggagagatagatatagatagagattgtatagagatagtgggatagagatggggatggagtaatttattttatatagtttttaaaattaagtgtaatgtatatttatattgatttagtaggtagatgttgaagttagttttttttaggtatgtttagagtatagtagtggtgttagtggatttagtagttgtagttagttgggtatattattttttattgtttttttttaaatggatgaatggtttttaagtatttatttttttgtttttgtgggttgtatttagggagattatggtgtggttattgtgtttttggtaatagttttggtagatgtattgttgattagggtagtagaaggtagatagtgggttgtggtgggtagggtagtattgttagttgtggttttttattggtttggttagtaggtggttttgtagtttgatgtttatttgatgtggttgtaagtgttttttatagtaatttattatgtaggttagataggattttattgtttttatttttttggtgttattaaggtagaagttatataggatttttttttttttattagtaggatttttttgttttgtagagttgttgttttgtttttttgtttttttgttaagtttttttgaggagtttatgttttttttttttattgggttggttgatttagaatttgggttgggtgatttagagtttgggttgagaggggttgggggttgagtagtggttttgggtagtggttttggagttattagatttaatttagttatttgggaggttttgtttttaggttgttttttttttgttttttggtttaggatttgtgtagtttaagttagataagagaattatgtttagatgattgtagttgttgtaagattttaattgtttttttttttttagaggaagtttggttatttattattgtgtgttggtgttggatggtagttagatgtgatgatgataaggtagttagagtatttaggtttaggatagttggtttaggtttaggttgtttttttaggtttagttttgaaatttttatttttatgtgaattatttgaattttataggttttgttgaagattatgtgtttttgtgtttgttttggaaaggatagaagatttttgagttttgttataagtttgtgtggttttgtgtggtttgataagtgatatttttttttgtttttatttttaaagagaagtaaaatgtaaggattttaatattaggatagttatttatttatttttattttatagaattggatatgaggtagttaggaataggatgtatgtttttttttttttttttttttttttttttgagatagagttttattttgttatttaggttggagtgtagtggtgtgattttggtttattgtaatttttgttttttgagtttaagtgatttttttgttttagttttttgagtagttgggattataggtatttgttattgtgtttggttaattttttttttttttttttgtatttttagtagagatggggttttattattttggttaggttggttttgaatttttgattttgtgatttatttgttttggttttttaaagtgttaggattataggtgagttatggtgtttattttttttttttttttttttttttttttgagatatagttttattttgttgtttaggttggagtgtagtgtgggattttggtttattgtaatttttgttttttgggtttgtgatttttttgttttagttttttgagtagttgggattataggtatttattattatgtttggtttatttttgtattattagtagagatagtgttttattatgttggttaggttggttttgaatttttgattttaggtgatttgtttgtttgggttttttaatgtgttgggattataggtatgagttattgtgtttagttaggatgtatatttttgatgttgatttttttatattatttttttgaatattttagtaatgtttgttatatttgtggagatgaatattatgtgggtatttagtggagattaggagggttagggaagatttgtttttttttatagaatgttttttttaggttaatagtttttttgtttatttaatgaaatatttttagatatggtgttatagttgagatatttgtttttataaattttatgttgagatttgatttttaatattggaggtggggtttggtgggaggtgtttgggttataggggtggattttttatgaatggtttggtgttatttttatagtgatgagtgagtttttgttttattaatattagttgttataagatttgattgttaaaaaagagtttggtattatttttttttttaatttttttttttttatgtgatttgtttattttagtttttttattttttttattgtggatggaagtggtttgaggtttttattagaagtagatgttagtattatgttttttgtatagtttgtaaaattgtgagttaaaagatttgttttttttatatgttatttttatttttttaggtatttttttatagtaatataaatatagtaagatgtatggtgtgtgagtttgttagggttgttatagtaaagaattatatattggttggttttaataatagaaatttatttttttatagttttagaagttggattaagttattggtagggatgtttttttttgaggtttttttttttggtttgtagatggttttttttatgtttttatatggttttttttttgtatgtatttgtgttttaattttttttttttataagaatattagtaagattagattagggtttatttttaattatttgtttaaagattttttttttaaatatagttatatttgaggtattaagggtaaagattttaatatatatatttgtaggggaaggagatataatttagtttgtaatatatggttagggtatgagtttggaagtttttagttttttagaagaaagaggttgtgaggtatgatttttggatgggggt

SEQ ID NO: 725 - DNA, 2526 bp, Artificial Sequence
  chemically treated genomic DNA (Homo sapiens)
gttattgtgttttgtgtgtttttagttaatttttataagagtttttttttttttttttttattatgtagtaagtattttttaagtttgttttgtgttaggtgttgtaggtgatattggaggatgtgaagtgaataaaataggtagtgtttaattttaagtaggaagtgttaagtttataggtgtttgatataggaataggaggaagggttagtaagaggtttgggatggtttttgggatttttatgggggggattagattaggtaatattgaatattatttagaggaagtggtagaattttaattttttagtttatttttttttgttttttttttgagatggagttttgttttgttatttgggttggtgggttggagtggagtggtgtgattttggtttattgtaatttttggtttttaggtttaagtgatttttttattttagttttttgagtattgggattagaggtatttgttattatgtttggttaatttttatttatttatttatttttatttttagtggagatgggtttttattttgttggttaggttggttttgaattgatttaaaatgatttgtttgttttggtttttttaagtgttgggtttataggtgtgagttattgtgtttggttattattttttttttttttttttaattagagatttttgttaagttattttttttattttattttatttttttttttattttttttttttttttttttttgagttataattattagttaggaagtattttttttttatttttttttttggattttttttattttttttttttatagtttatttttgtgtttttaggtttagggtttatttgtttagagtttggaaaatttttagttttttttttttttttttatagtgtgggggtagggtattggtgttagttatgtgtttttggtttttgaagaagattttagattggggttggggggtgggttttgtttatttttttagtattttattgtttttattatttgtgttttttttttttttttaaatggaattttttgtttttttgtttgtttatagttgtttaattgtaaaagttaggttgtttgtgggagattatagatagtgattttttttatttattggttgagaggagggtaaaggggtggttgtaatttgggtaataattttatttttattttagaagttatagttatattgttaagtttttttttttttttgttttaggatagttttaaaaatgttaaaagtatttttgttgggtagtatttggttagggttgttttttttgtttgtttaggaatgtttgttattttagagagtttaagtgatttgttttggttatatagtagtagtttgataggttgttagggttttaggggtagaaggaggagagggttggtattttttttattggtttgtgtgattgtagtattggggtgtagtgaagttttaagggttttaatttgtgagtttttttttattttaggtaggggtgggggagtagtagtggggtgttggtttttaaatgtaagataagagttggttaagaaagttttgtttagtttttttatttagagggaatgggagggagagaagttgagggtagggttttggttttgtgtggagatagttgtgtttttgtggtttttttaaatgtttagatgggtaatgatgtgtgtggatgagggtggggttgggtttaggtttggttatatgatttggtttgaggtgtttgtggtttttattttattagtgggtgttttttttatgtgtggttgattattattggttggtggtgaggttaatagaaattggttatttgggaatttagtgttttgaggtgtagtttaatatagtgaattgatgaaggtttaatggaaaaagatggttatgggtatagattaatgataaagtggtaggggtgggtttaagggttgggttaggttggtttgagaggtgggtgggtataaaagtgtaaggtgggtggtggtgtttgtttgtattgtagagttgttgttggagggttgttttaaagggtttgtgtgttgttgtttttttggtttgttatgttgttatttgtgttgttgttgtttggtttttttggtttggttgttgttgagtttgttgtttattttaaggagtagtttttggatggaggtaatgtttggttttgttttgaggttgttttgatgatgtggttggtttttgattttggatttgtgttgttgtttgtaattattgtttagaggtttaatatggtggttttttgggattagagttgtgggtgattttttttttgtgtttttggggagtgtggagggtgtagtggttttttgtggtgggagttagggttagtttgaggatttttgaaggtatttgatgtgttaaattagaggttggaatggggagtgttggggatttttttttttgtttttagtagtttgtggtttttggtagatgtttggtgtggggggggattagtatagttgttttgatttatttttttaattttttatttaga

SEQ ID NO: 726 - DNA, 2526 bp, Artificial Sequence
  chemically treated genomic DNA (Homo sapiens)
tttaagtgggggattagaggggtaggttagagtggttgtgttaatttttttttatattaaatatttgttgagagttataagttgttggggataggaaaggagatttttgatattttttattttaatttttagtttgatatgttgggtgtttttagagatttttgggttaattttaatttttgttgtgggaggttgttatgttttttgtgttttttagggatgtagaagagaaattgtttgtggttttagttttgggaggttattgtgttggatttttaaatggtaattatgggtgataatgtagatttaggattgggggttggttgtgttgttggggtggttttgaggtgggattaggtgttatttttgtttagaaattgttttttgaagtagatggtaggtttggtgatggttaggttgaggaggttgagtagtagtggtatggatagtagtatggtgggttgagggggtggtaatgtgtgggttttttaaaatgattttttggtagtggttttgtagtatggatggatgttgttgtttgttttgtatttttatatttatttgttttttaaattaatttgatttagtttttgggtttgtttttgttattttgttattggtttatgtttatggttgtttttttttattggatttttgttggtttattatgttaggttgtgttttggaatgttgggtttttagatggttgatttttattggttttattattgattaatgatggttgattatgtgtgggggggatgtttattggtggggtgggggttgtgagtattttaggttaggttatgtgattagatttgaatttaattttgtttttgtttgtgtgtgttgttgtttatttgggtgtttaaagaaattgtgggagtgtagttgtttttatgtgggattgggattttgtttttagttttttttttttttattttttttaggtggaggggttgggtaaggtttttttagttagtttttattttgtatttgagaattagtattttattgttgtttttttatttttgtttgggatgggagagagtttatggattggggtttttggggttttgttgtattttggtgttatagttatgtgggttggtgggaagaatgttagtttttttttttttttgtttttagagttttggtagtttattggattgttgttgtgtgattggggtaagttatttaagttttttgaagtgatagatgtttttgagtagatagagggggtgattttggttagatgttatttagtagaaatgtttttaatgtttttaaagttgttttgggataagaggggaggaaggtttaatgatgtgattgtgatttttggagtggggatagggttattatttagattgtagttgtttttttattttttttttaattggtaaatgaagggggttgttgtttgtggttttttataaatggtttggtttttgtaattaaatggttataggtaggtgagagggtagggggttttgtttggggagggaaaaaagatatagatggtagggatgataagatgttagggagatgggtaggatttattttttgattttagtttagagttttttttagaagttagaggtatgtgattggtattagtattttgtttttatgttgtagaaaggaggaaggagagttgggggttttttaaattttgggtaaataagttttggatttgggagtgtgggagtggattatggaaggagggaatgagggggatttaggaaagagggtggggagggggtgttttttggttaatggttgtgatttagaaaagagaggaaggaaaaaatgaaaaggaaaataaagtggagtggggggaatgatttggtaagggtttttggttaaaaaaaaaaaaaagaaatggtggttgggtgtagtggtttatgtttgtaaatttagtatttggggaggttgaggtgggtagattattttaggttagtttgagattagtttggttaataaggtgaaaatttatttttattaaaaataaaaataaataaataaataaaaattagttaggtgtggtggtgggtgtttttaattttagtatttgggaggttgaggtgggagaattgtttgaatttgggagttagagattgtagtgagttaagattatgttattttattttagtttattagtttaggtgatagagtaagattttattttgaaaaaaagatgggggagaatgaattgggaagttggggttttattattttttttaggtagtatttagtattgtttagtttggttttttttatgaggattttggggattattttaggttttttgttgatttttttttttgtttttgtgttaggtatttgtgggtttggtgttttttatttgaggttagatattgtttgttttgtttattttgtattttttagtgttatttgtagtatttggtatagaataggtttaaaaagtatttgttgtatgatagaagagaggaaggaaggatttttgtggaaattaattaaaaatatatggggtatagtggt

SEQ ID NO: 727 - DNA, 10517 bp, Artificial Sequence
  chemically treated genomic DNA (Homo sapiens)
ttggagtttgttttttttgttgttttttgtttatattagtagttttatttttagtgttgttttaatgtagttattgggggaggagggttttattttttaaggttttagttatttattttttttttgtattgttttttttggttaattaggatggagtaggggttagtttttttgagggttaggttttttgtgtttttgtttgtttttgtagagattgttgtttggggttttgttagtagggtattgtttgtttatgaggtttggttttttttttttatagaagtggaggtttagggatgattttaggtttttgagggttttgttggtttagatttgttttttgggaagttggtgtgttagttaggttgaggagtgggtggttggatagggttagggtgtaggaggggtttggtatagtttttgggaataagtaggaggagatgttttaggtagtttttttgaaggttggttttttttttgaggtgaggtgggttgtgttggggaggtatagggtgttggttagttgttttgttttttttgaggattttgggttatgttttgttttattttattgttttttttttatttgttgtgttgtgagttttggttaatgttttttaagttaaatattgaagaaatgtagatgtttagttttttgggaggggtgggatataggagtttgttttttaattagttttttagagtatttgagtagtaaattatgggttgttttagtttttttttagatgagaaaggagtttagagaggggagagggtttgttaaggtggtatatttggttaggtgttgtgtaggttgagttttgggggttagatagaggggtagttgtaggtttatttgggtttgtgttttttataggttatgtttgagaattttttgttgtgtgaagttgggtttattttgttgtttttttgttattagggttgttttgtggtattttattgtttagttagtggtttaggattgttgattgagggttttgtttggtttggattaggtttggttttattatttttttgtagattgtgtttttttggtttggtttaggggttttggtattttggttttgttgtatggggtgatagttattgatttgtaattgagtaaggggtaatttaggagagttaaggttgtttttatttggttttttttgagtgatttttttttttattttttttatttttttagtgttgtttttttattttatgttgttgaagtagatgagttggagtaggatttaggagggtattaggtttaggttttaggttgaatttaggaatgagtaatgagaggaggtagattagttggaggattagtttgagtttttagatgttggtataatgtaggggaaggtaggtgttgtttgtgaaaagtgttgggttgagagtttgttagtttttttgtttgaggttttattttttggggtttttatatggtgggattgtttatagttggagttgtggtggtgatgatttgttttttataggttggggtatgtttttttttttttttttttagatttagatttgagttttatggtttatggatatgtgatgaatgttttggggttggttagtgggaaagataagttgatttgaggttatgttttggttttggaggaagaaggtaaattgggtagtttttttagaagtggaggagtttgtgtaggtttttggtgtgtttttgtttgggtggaaggtggggatgtgtatttgttggagagtggtgttttgtgttttaggttggaagtttggttttgggtaggggtttggagttttggggttggaggtggggggtggggtggggggtggtttttattgggtgggtttttgtttgtgtgtttgtgtttttgataggtggtttatttgtatggagagtggtggtggttaatgggtgtgtgtggttgggtatgttgggattgggttgggttggttgggttgtggtggtaggtggagagtggttggattggttttgggtggttgaggtggtagttgtgtggtggtattggggtggttgtggtgtgtttggagttttgagggtatgtggtttgggtagtttggtgtgtgtttttgtgagagttggggttttaggtttgttggatattatgaattatttggtgagggtgttaggtggggttgggttgtgtatgggtttggaggtggtagtgggttggaaggggttagtgagtggtattttttgttggatttgtggggtttgggaattgttggttggggtttgtggttttgggatttttttttgttttggttgggaagttgggaggtaggaattgtgggggttttggagtttgtgtgttttgggtgtgttggtggggttgggtgtgggggttgttagttggtaggagggtttttgtgttgggaaagtggttggtggggtttgtgttttttggttgatggttgtttgttgtgttattttgggtttttgtgttttgtttttgagttttagtttttttggttgtgaggaggggttgttgagtttttggtgggtggtttggttggtgtggtgtggggattgtttattggtttttggagagggaggagttttgggggattgaggttgggtgggtaagtgtgtggtgttagtggggaaggttgtgtagttggagtatttggttttagttaatgatttattttggttgttggtgtggggttttgggagtggagtgggagtgggggtgggtgtgttgtgggttttgtagttttgtatgttgagtgttggtggaagttgggttttggttataggagttttagttgtatgtgagtgttgtgggagggggttagggttgggttttgtagtgtggatatgaaggttttggagtttatggttgggggatttgtaagagttagagtagggttggagtttttttttgagggtttgagaggttgattgttggattgaggtgagggagttgggaaagtggagatttgtttaggggtgtggggtgaggggtttatggtttggaagatgttggggttttgagttttagattggggatagtagttttttttttattataaggtttttgtttttttttgagagtttttggtttttttttttatattttttttggggtttgttgtagttttggttatttttttagaatgattatgggttgattttttttttgttagtgagatgttttttattgttttgggttgggatatgtttttttttgtgtttattttttttttttggtggagagttgggtggtgggggttggttggtttgtgagagtaggtgttggggtgtttggagaattggggtttaggtatgggggtggtggggttgtggggaaaagagttttggggaggagttgttgatatttttttttggtattgtttgtttgggagttgggtggaggtagggtagggtagggtagttttaggttttgttaggaaagttattttgggttggggtaggaggtttggagtttttggttgttattgtttgtttgagtaggagggtgagtattgtgtattggtattatggttttaggtttaggtgagggatggaaataaggatagtgttattagggttttttgtttgtataggaggggttttgagatagttttttaaattttttttttattatatggatggtgtagatggggatattgaggtatagagagatagttagttgtttttagaattggatttagaattttgttttttggtatggttttttagtgtagtattatatgtggtttttgaatttttagtttgggattgggggagttttggtttttgggggattattatgtttttttggagttgttaatttggtaggaattttttggttttaatgttgtgtttttgtggtttttttttggtatttgttgtttttttaggaggttttattattttttttttttgagtttggataatttttttttttgtttttaggagtttatagttggttaaattaattggttagttagaattaattagtaggggaggtgtgttttaggggggtttttaagaggaggtagttttggagttagaggtgaagtgtggggagtgggattgggtgatagggaagtttttttagtaaagatattgggtaagttttttttttggtttttagataaagggttgtagggtggtttttgtgtaagagggtggggttttgttttttgttaggttttttttggttttttgagtataggagaggttttggttttatttgtgttttgtttttttgatttttttttatttttatattttagtttggggtagaagtagggtggaggggtgggtttagtttttttgatgatatagttggggttggaggtgggggttatttttattttgggtttggtgttgtttttgaagttaggggttagttttatattgagttttttgttaaaattttggattataagtatgagttttagtaggtttgtttgagtgaatattgttgattttgtttgtaggggtataggtttggggtttgttagttgtttgtattgtttgtggggtgttttgggttgtaggttttatgttttgaagtagtgagagttttttttatgttattttttttgtttagttttttagggatagtgtttgggatgttttggttggagtgaggattggggtgtgtttttagtttatagttggttttgggtataaaggtatttgttgtggtgttgtagttaaggttaggttgtgttttgtgtttgtgttggggagtttttggtagtggttattttataggtggttttttatttttttttgttgttgagtgttatgtgtggggttgagggtttgtatgtttttttggttttattttttttgatgatttatgtttttttaaggttggtaggataggagttatgtttttttggggtggttttggaatgtgggttttgtgtataggttatgtagtttgtttatatttttgttgtttgttatttgggtatttaggatttgagtttagattttggttattttgttgttgtgggagtattaggggaagttgttattaaggttggtaggttttggagttttatttaggatggggatatgggggagggaagaggaggtgttttttagagtttgaggttaggattaagtggggtgattaggatttttttaggtgggttttgggtgtggatggttagttgggtgtatgtttattgggtttgtatttgttggttatggaggttttttgggataagtaaatagaatgttttagaaataaatttggtttaagtttgtgatggttttgggtatgaaagaagttagtgttttttaagtgtttgttatgtgtgaggttttgtgttggggtgggtgtatgtgtgtgttgggggtgtggataggaggggtgggaaaggtttgtgatattttttttggtggtttttatgaatttaggtgttattttttggtggagataaagtggagttatttagttttattgtgttttagtttggggttggtttttgttgtttttggatttagtgattttgggttgttagggagtttttgagttttggtttttttgtttagtaagatggaggtaattgtgttttatggggttgttttgagggttaaatgagttggtggttgtgtgggaaagagttttgttttttgtagggaggaattgtgttgtttttattattgtgaatttagtgataagtgtggtattattatttatttttttgtttgtttttaattttggggttttgggtagagaataggagtttttgttatttttttttagtttttattttgtgttggtttgtgggtgttgaggttatatttgttgggtgaaagggtgtaggttagatatgagttaggtttggtagagagggttttggttagtagtgatatttgtagtgttttttgtagttggtttgggttggttttgtttttgagaatttttgggttgtttttttaggtaattagggaaggttttttggagtagtagtatttttttttattatttgttgatattagtttttgtttgatttagagaaggagtttggggatagttatagtatgtttagggtttttaaggtagttggtagagttaatgaggagattttaatatttatttgatggttgtagttttttttgatgtgtgttatttgtagttttggttttagttgttgtgttttttagggtttgtttgtttagtttgggtggatatggtgtttaggtgggttttggggatataatgagggttatttttagagttaggtagagtgtgtggggtagttttgttagttttatgtgtaatagttgggatattgtttagggagtgttggtattaggttggggttttttttttttggttttgttttttgggatgagtaagtttttaaaggtttttttgggtttttttggtgtatgtgttttggagttatttttttgaaggaggtagatttgtttttttgttttgggtgtttggggtgtaggggtgtgaattgggttatgttaagatatgttgggtagtattgtgaggtgggggtagaggggagaaggtgttttaggaggagtttttttggaggggatgatagtttagtatgttttgaagtgggagtagggtgtggtaggagtagggtattagagaatgagtgagttaggtagtagtttttattgtgttttggatataggtggttgatagtgtttatttggattggttttgtattttttttgaggttatagttgtgttttttgaaaatttgggtaggagtatttgattggtttagtttgggttatgttttaggtttagtagtgtgggaggttaggaaagtaggtttggggaggttggttttttttttagtttgaagtatggtaggggttttgggggaggttgttggggggtttgtgagtatgtttagagtaggaatgtttggggtggtgtgtgttttgtttgtttgggtttatttggttgtggggaagttggttgtgtggatgatgtttattgagttgtgtatgtattatttatggagtttgtggtgtgagtttttttgttgttttagggttatagtttgtttttttgttttagttttttggttgaggttttttttttgttttatgttttttttagataggaattttgtggaatgttatttttttggggaggttgtttttgattttgtatgtaaaggtttttttttatattatttttggtattttatttttttttttgtgaaagtaaattgtttggtgtttttttgttttattatagtataggtttggtttagatagaggttttgtttattaggtttgtgttatttttgtggagtttagttaaagtaggggttaggtgaattttttgttaaaagaataatgtgtgttgggtatagtggtttatgtttgtaattttagtattttgggagtttgaagttggaggattatttgagtttaagagtttgagattattttgggtaatataaggagaatttatttttatataaaattagttgggtgtggtggtgtatgtttgtagttttagttatttgggaggttaaggtgggaggtggttgaggtgggaggattatttgagtttgggaggttgttgtagtgagagttatgattgtgttattgggtaatagagtagaatttagttttaaaaaaaaaaaaaaaaaaaaaaaaaaaaagaataattttatgaaatgagggttgttatttagtagagaggatttagatgtttagagaggttaagggatttgtttaaagttttatagttgggtttaggtttgagtttgtttagtgaggaagaaggagtgtatgtttttagggaatagaataggaggtagagaggtttggagaggtgggggttttggttagttggagtggttggttgtgtattagtagtgtttagagtttaggttgggtgggggtatattagttgatgtaggtggggaagtttttggtgttaggtgtttggtgttatgtgtttagtttgtgagatgttttttagtttggttttagtggttttagattgggttgtggttgattagtgagtttatgtttggtagggttgggttgtgaggttagaggttttagttgtttatttgggttgggttttttttttttgtagggtttttttttttatagagtttttggtttttttgtttgtgtttttttagtttttttgagtgtttggttttgtttgatggggtttttgttagttttttttgggttatttttttaggaggtgaggggtttttgtggggtggttttttttgtttaaatttttattttttttgatttggttggaggggaatttttttgtgatttattttgttggtattttttgtggttattagggtaggggttgggggatttggaggggtagttttgtggtgtgtagggttattggggaagggtggtttgtttttgatgggttgtgatttttagaggtaggttgtagattatatttgggaaatgtttgttttgttggttgtttgggatgggggttttgagtttggtgggttgtaggatagtttttgtttttttgtttttttgtggggttttggtttttagatttgttgtattgtttgttttgttttgttttagagtttgggatatagtttattgttttttttttttttttttttgtgtagttttttagttttaaagtaagaaatatttatttttgaaaaataggaagagaaattatttttattgttttagatatttttggtgtttttttgatttttttttgtttttatgttttataggatatttttttgagatgtgttttttatttgagtgttttttttattttgttgtaattatggtgtggatagtgttgtagttatttagggtttttgtttttgtgtttattttggttttaatatgattttatttgggtttgtttttttttagttgttttttggttttttttttgggttttgttttttttggttttttatattttagtttttggtttttttagggattggaggtttttagttgttttggagaaatgggttttttgttgatgatgtttatttaggggtaagtgaattatggggtttgaatgtttgattttgggatttggggtaattattgtttatttaggttgttgtttggtatgttattgttttttgatgttggttagggagatggtgtttagaggggtattgtttagtttttgtttatataggggaggagggtgggttttagggatttgaaagaggttttatttttatttttttgttttaaggtataggtttttgttttttgtttttgtttaagggggtgtggtttttttttttttgttttattttttgtagatggagtttagaaagtgggatttgggtttaagtggggatggttatatagttattggttggttagaatttaggttttatttttgagttagagttttgattaggttgtatatttaagatgttaggagattttgaggagggattttgtagggtagtttagagttgaggttaggttggtggggtggttggagtttagtgttggttattgtttagttagtttggtattgtttttatatttggtttttttgtgtgtgaagtttggggtttttgtggaatttatgtagttttttgttgttttaggaggggttgtagttttggttttgttttattttgtgttttttttatatttgttttttgttgtaattgtttatattttttagttagggattttttgtttttttgggtttattttgtgtttggtattttgatggggtagtagtggtaggggtgaggatgtatgagtgtgtggtgggaaattgtgaggtttttttgtttgggttttagtgttttagtgaggttttgtttttgtttttgttatggtatttatgtttttgattttatagttttttttaagttttttttggattgtttggtttttgggttatatggagtatgtatttggttttgtaagggtttgttgagggtgatggggttaggatagggagggtgtgttttttgttttttttttagttttggggaaggtgtttgaagtttttaaattaattattgattttttggatttggggtagatagattttgttaaggaagttttgttttattgttgtttatttttttattttaagaagttgttttttttgttagattatttttgtgtattttgagagagaattatttgttatttgttttaatttggtagttttgttgtgattattgttgttttttttgtgttggtttaggtagtagagtggttttgggtggggtttttagggatattttgagggttatttttggagttttggtggtgatagtggttaagaggattttgaggtgttatataggtgtagttgaaagaaaggttaggattagttgggtttttttgttggggaataggtggggatagtggaggtaaaggtataatgattttgttaaattttattgagttttttttttagtattaaagttgggtatttttttagagtagggtaggagttggggagtttttgatgttttatgtatatttttttgtttttatatttgtgttttttttttttaga

SEQ ID NO: 728 - DNA, 10517 bp, Artificial Sequence
  chemically treated genomic DNA (Homo sapiens)
tttggggagagaggatataggtgtgagaatagaaggatgtgtatggggtgttaggggttttttagtttttgttttgttttggggaggtgtttagttttgatattaggaaaagaatttagtggagtttggtgagattattgtgtttttgtttttattgtttttatttgttttttagtagaaaggtttagttgattttggttttttttttaattgtatttgtatagtattttaaaatttttttgattattgttattattaaaattttagggatgatttttaagatatttttaaaagttttatttaaggttattttgttatttggattaatataaggagagtggtagtaattatgataaagttgttaagttaaaataaatagtaaatggtttttttttgaggtgtatgaaaataatttgataaaaagaatagttttttaggataaaaaaatgaataataataagatagagtttttttaataaagtttatttattttaaatttaaaaagttagtaattaatttagaaattttaaatattttttttaaggttgggaaagaaataggaggtatattttttttgttttggttttgttgtttttagtaaatttttgtagagttgggtatgtgttttatgtggtttaggagttaagtagtttgagagggatttggaggaggttgtgggattagaggtatgagtgttgtggtgagggtaggggtggagttttgttgggatattagagtttaggtagggaggttttgtagttttttattatatatttatgtatttttgtttttgttgttgttgttttattgaggtgttaggtgtaggatgggtttagagagatagaggatttttggttggagggtgtgggtggttgtagtaaaaggtaggtgtgagggaggtatggggtgagataaggttagggttgtggttttttttagggtagtagagggttgtatgggttttataggggttttagattttatatatagggaagttgggtgtgagaatagtgttaggttggttggatagtgattggtattgggttttagttattttattagtttggttttagttttgggttgttttgtaaggtttttttttagagttttttggtgttttagatgtgtagtttggttgagattttgatttggaaatgggatttgggttttggttagttagtagttgtgtgattatttttatttgggtttaagttttattttttggattttatttgtaaggagtgaaataaggaagaaagggttatgtttttttgggtagaaataggaagtaggagtttgtgttttggggtagaggagtgggggtgaggttttttttaagtttttagggtttattttttttttttatatgagtaggggttggatagtgtttttttgagtgttatttttttggttggtattagagggtgatggtatattaggtagtggtttgggtaggtagtagttgttttaggttttaggattagatatttagattttatggtttatttgtttttgggtggatattattagtagggagtttatttttttagagtagttaggagtttttagtttttaaaagggttagaggttggagtgtggagagttaggaggagtaaggtttaagggaggggttagggggtagttaggagagggtaggtttaggtggagttatattggagttaaggtgagtataagggtagaggttttggatggttgtaatattgtttatattatgattataataaaatgaaaaaggtatttaagtgaaaagtatattttaagaaaatgttttgtgaaatgtaaagataagagagggttaggaagatattagagatgtttgagataatggagatagtttttttttttgttttttaggaatgagtgttttttgttttggggttgaaaaattatataaaaagaaaaaaaaagaaaatggtggattatgttttaggttttgaggtaggatgggataggtagtgtggtaggtttaggggttagagttttatagaggagtgggagggtgggggttgttttgtagtttattgggtttagggtttttattttaggtggttagtaagataagtattttttaaatatggtttgtagtttgtttttgggaattatagtttattgggggtgggttatttttttttagtgattttatatattatagagttgtttttttgggttttttagtttttgttttggtgattataggaagtgttagtagagtgagttataggaaaatttttttttagttaagttagagaaggtgggggtttagatagaggggattgttttgtgaaggttttttattttttaggagggtggtttaggaaaggttggtagaggttttattaggtagggttaggtatttagagaggttgagggagtataggtagggaggttgggggttttgtggagggaagggttttgtagggagggaaagtttggtttaggtgagtggttggggtttttggttttatagtttagttttgttaggtatgagtttattgattggttatagtttagtttggggttgttgaagttaggttgggaagtattttataggttgggtatgtggtattaggtgtttggtattaggagtttttttgtttgtgttagttggtgtgtttttgtttagtttgagttttggatgttgttggtatataattgattattttagttggttagggtttttgtttttttgggtttttttgttttttgttttgttttttaaggatatgtatttttttttttttattaggtagatttagatttgggtttggttgtgggattttgggtaaattttttagtttttttgagtatttagattttttttgttggatgatagtttttattttataggattgttttttttttttttttttttttttttttttttgagattgggttttgttttattgtttagtagtgtgattatggtttttattgtaataattttttaggtttaagtgatttttttattttagttattttttattttagttttttaagtagttaggattataggtatatattattatgtttagttaattttgtgtagagatgggttttttttatgttgtttagggtggttttaaatttttgggtttaagtgattttttagttttggatttttaaagtgttgggattataggtgtgagttattgtgtttagtgtgtattgtttttttaataaaagatttgtttggtttttgttttggttgggttttgtagagatagtgtaggtttagtggataaggtttttgtttgaattgggtttatattgtagtgggatagaaagatattaaataatttgtttttatggggaagaaagtggggtgttaaaaataatgtgggagaaggtttttgtatatagggttagagatggtttttttaaagagatgatattttataggatttttgtttgagaagagtatggggtagaggaagggttttagttagggggttggagtagggaggtaggttgtgattttggagtggtaaaaggatttatattgtagattttatggatgatgtgtgtatagtttagtgaatgttatttgtataattagtttttttatggttagataagtttagatgagtaaagtatatattattttaagtatttttgttttggatatgtttgtaggttttttagtagttttttttggaatttttgttatgttttaaattggaggagaggttagtttttttaagtttatttttttggttttttgtattgttgggtttagggtatgatttaagttgggttagttaggtgtttttgtttaagtttttaagggatataattgtgattttagaaggggtgtaaagttagtttaggtggatattgttagttatttgtgtttaaggtgtagtggaggttgttgtttgatttatttattttttggtattttatttttgttgtattttatttttattttagaatatgttggattattattttttttaggaaggttttttttgggatatttttttttttttgtttttattttatagtattgtttagtatattttgatatagtttaatttatatttttgtattttaggtatttaggataggaggataagtttattttttttagaagggtaattttagggtatgtgtattagaggaatttaggaaggtttttgggggtttgtttattttaaagggtagggttagaggaggagagttttagtttgatgttagtattttttaaataatattttagttgttgtatataggattgataggattgttttatatgttttgtttggttttgagaatggtttttattgtgtttttggggtttgtttgggtattatatttatttgggttgggtaggtaggttttgagaagtatagtggttgggattagggttgtgggtgatatatgttagggagagttgtagttgttggatgggtgttggggtttttttattggttttgttagttgttttgggagttttggatgtgttgtggttgtttttaaattttttttttgggttaggtggaagttggtgttggtgagtggtaaggggagatgttgttgttttaaggagttttttttggttgtttgaagggataatttaggagtttttaggagtagggttagtttaaattaattgtagagaatattgtaggtattattgttgattaaaattttttttgttaggtttggtttatatttggtttgtatttttttatttagtaaatatgattttagtatttgtaagttagtataaggtgggagttgggagaaaatggtaagaatttttgttttttgtttaagattttagggttgggggtagataaggaaatgggtaatagtgttatatttgttattaagtttataataataagaatagtatagtttttttttgtgggaggtagagtttttttttatatagttattagtttatttaatttttaaaataattttataagatatgattatttttattttattagataggaaaattaaggtttagaagttttttgatagtttagggttattgagtttagaagtagtagaggttgattttaggttgagatatggtggagttgggtggttttattttatttttattgaggggtgatgtttgggtttgtggaaattattagaggaaatgttataggttttttttattttttttgtttatgtttttaatgtatatatgtatttgttttagtatagagttttgtatatagtaggtatttgggaaatattgattttttttatatttagaattattataaatttgggttaagtttatttttggggtattttatttgtttgttttaaagagtttttgtggttaatggatgtaggtttaataagtatgtgtttaattggttatttgtatttgggatttatttggaggggttttgattattttatttggttttggttttaggttttgaggggtattttttttttttttttttatgtttttattttgggtggaattttaggatttgttagttttagtggtaattttttttaatatttttataataatagggtggttagggtttgggtttaagttttgggtgtttgggtggtaggtagtaagggtgtgagtagattatatagtttgtgtatggggtttatgttttagagttattttaggggagtatggtttttattttgttagttttaggagggtgtgaattgttggagaggatgaggttgggaaggtgtgtaggtttttagttttatgtgtgatatttagtagtaggagggaataaaaagttatttgtggggtggttattgttaagggttttttgatataagtatagagtatagtttggttttggttgtagtattatagtagatgtttttatgtttagggttagttatgggttgaaagtatattttagtttttattttagttagggtattttaggtattgtttttaagaggttgggtagaggaggtggtatggggagggtttttattgttttaggatatggaatttgtaatttaaaatattttatagatagtgtggatggttggtaggttttaggtttatatttttgtaggtaggattagtggtgtttatttaagtggatttgttggagtttatgtttgtgatttggggttttggtagagagtttggtgtgaggttgatttttgattttagggatagtattaggtttagaataggggtagtttttatttttaattttaattgtgttattaaggaggttagatttatttttttattttatttttgttttaggttagaatgtagaggtgggaggaagttagggaagtaagatataggtggagttagggttttttttgtgtttggagggttaggaagggtttgatagagggtagagttttatttttttatatggagattattttgtagttttttatttgggggttaaggaagaggtttgtttagtgtttttgttggagaaatttttttattatttaattttattttttatattttatttttgattttaaaattgtttttttttagaagtttttttggagtgtattttttttgttggttggttttagttgattagttggtttagttggttgtgggtttttgggggtaagggaaggagttgtttaggtttagaagaaaagggtggtaggattttttaaagggatagtagatgttaggagagggttgtaaaggtatagtgttggaattagagggtttttattaagttgataattttaaaagagtatggtggttttttaaggattagagtttttttaattttagattgggaatttggaggttatatgtggtgttgtattggggggttatgttagaagatgaggttttggatttaattttgaggataattgattgtttttttgtattttagtgtttttatttgtattatttgtataatgggaaaggggtttgaggagttgttttagggttttttttgtatagataggaggttttagtggtattgtttttatttttattttttgtttagatttggggttatggtattagtatatagtgtttatttttttgtttagataaatagtaatggttagaagttttaagttttttgttttagtttaaggtgatttttttggtagaatttgggattgttttgttttgttttgtttttatttagtttttgggtaagtagtgttaggaggaagtgttagtagtttttttttaaagtttttttttttatagttttgttatttttgtatttgggttttgattttttaggtattttgatatttgtttttataggttggttagtttttattatttaattttttattgagggaaaggaatgggtataagagggggtgtgttttggtttagggtgatgggaaatattttattagtaaagaagagattaatttatggttattttgagaaggtgattaaagttgtggtgggttttgggaggggtgtgggaaaggaaattagggatttttaggagggaatgggagttttgtggtagaaaaggagttgttgtttttgatttggaatttgaaattttaatattttttaggttgtaagttttttattttgtatttttaggtaaatttttgtttttttaatttttttattttggtttagtgattagttttttggatttttgagagggagttttgattttgttttagtttttgtgggttttttaattatggattttaaagtttttatgtttatattgtagaatttggttttggtttttttttgtgatatttgtgtgtggttaggatttttgtggttaggatttggtttttattggtgtttggtgtgtggggttgtaaagtttgtggtgtgtttgtttttatttttgttttgtttttggaattttgtgttggtggttggagtgaattattaattggagttgggtgttttggttgtgtagttttttttgttggtgttatgtatttgtttgtttggttttggttttttggagtttttttttttttgggagttggtgggtagtttttatgttatattagttggattatttgttagaggtttaatggtttttttttgtagttgaggaaattgaggtttggaggtagggtgtagaggtttaaggtgatatagtaggtggttgttggttggggagtgtgggttttgttagttatttttttgatataggaatttttttattggttggtggtttttgtgtttggttttgttaatgtatttgaggtgtataggttttggagtttttgtggtttttgttttttggttttttggttagggtagaaggagattttagggttgtggattttggttggtggtttttaggttttgtaggtttggtaggaaatgttgtttgttaattttttttagtttgttgttgtttttaagtttgtatgtggtttggttttatttggtgtttttattaggtggtttatggtgtttggtgggtttggggttttggtttttgtgggggtgtatattgagttgtttgggttgtgtgtttttggggttttgagtgtgttgtagttgttttggtgttgttgtgtagttgttgttttggttatttagagttggtttagttgttttttgtttgttgttatggtttagttggtttagtttgattttagtatgtttggttgtgtgtgtttattggttgttgttgttttttatgtaaataagttgtttgttgggggtgtgggtgtgtagatagaagtttgtttagtaggggttgttttttgttttgttttttatttttaattttgaggttttaggtttttgtttgaggttaggtttttagtttagggtgtaggatattgttttttaataaatgtatgtttttgttttttatttaggtgagaatgtattgaaggtttatgtaaatttttttatttttgggaaggttgtttggtttgttttttttttttagagttgagatatggttttaagttgatttgttttttttgttaattaattttagggtatttattgtgtgtttatgggttgtgggatttaaatttgaatttagagggaaaggggagggggtgtgttttagtttgtaggagatgaattattattattatagttttgattgtagatggttttattgtgtaaggattttaggaaatgaagttttaagtagggaggttggtgagtttttgatttagtgttttttatgggtagtatttatttttttttgtattgtgttgatatttggggatttgggttggttttttagttgatttgtttttttttattatttatttttaggtttagtttaaaatttgggtttagtatttttttgagttttgttttaatttatttgttttagtgatatggggtaggagagtggtattgggggaatgagggagatagaaggaagaattatttgggggaaattgagtggagataattttggtttttttgagttgttttttgtttggttgtaggttagtgattgttattttatgtagtagaattagggtgttagagtttttgggttaggttagggaggtataatttgtagggagatgataggattgagtttggtttagattagataggatttttagttaataattttgggttattggttgagtaatgggatgttatgaggtagttttggtggtagggaagtagtggggtagatttggttttatgtagtagagaatttttaagtatggtttatggaagatataagtttaggtgggtttgtagttgtttttttgtttgatttttagggtttagtttatgtagtgtttggttagatgtgttattttggtaggtttttttttttttttgggttttttttttatttgaaaaggggttaggatagtttatgatttgttgtttaggtgttttggggagttagttaaaaaatagatttttgtgttttattttttttaaaaaattggatgtttgtatttttttaatatttggtttgggaagtattggttagaatttatagtatagtgggtgaggaaggagtagtgggatgagatagagtatgatttagagtttttaggaggaatagaatagttagttaatattttgtgtttttttgatatagtttgttttgttttagaagaggagttagtttttagggaagttgtttggagtatttttttttgtttgtttttaagagttgtgttgggttttttttgtattttgattttgtttagttatttattttttagtttggttggtatattagttttttagagagtaggtttgaattagtgggatttttaggagtttgaggttatttttgggtttttatttttgtggggaggggagattaggttttatgggtaggtagtgttttgttggtagggttttaggtagtagtttttgtagggatgggtaaggatataaaaggtttggtttttaagggagttggtttttgttttattttagttggttaaggagggtggtgtagagaggaggtggatggttggaattttgggggatgagattttttttttttagtagttgtattagaatagtattgggggtggggttgttggtgtgagtaggaggtagtaagggaaataggttttga

SEQ ID NO: 729 - DNA, 9859 bp, Artificial Sequence
  chemically treated genomic DNA (Homo sapiens)
ttatttagtattaaaatatggggtgggtttggtatggtggtttatgtttgtaattttagtattttgggagttttgagtttggtagattatttgagtttaggagtttgagattagtttgggaaatatggtgaaattttatttttattaaaaatataaaaaattagttaggtgtggtggtgtgtatttgtggttttagttatttgggagattgaggtaggagaattattttagtttgggaagttaaggttgtaatgagttgagattatattattgtattttagtttgggatagagtgagattttgttttaaaaagaatttaaaaaaaaaaaaaaaaaaaaggaaattattagttttaaattatttatttttggagaaatatggatataaatttaaattgtatgttttttttattatattatagtgtttttttgtaaaagtggtaattttgggttggtttatatgaatttgttgaaatttttataatatattggtggtgttgaatatttggggtttttgaatgtaagtttgtaattaggatgttggtgtatatttttattttggaatgtttagttttgatttttttttttttagaatggttttatatttatttatttgtaatatagtgtttaatagtaggaagttttgagttaaatgtttagttttgttatttatttttgatttgagtaagttatttagtttttttaggtgttatttttttgtattttaaaatggagatgataatagtatttattttataggattgttgtgaagattaaatgagtttagggtaatgttatatataggttagtattatttattaatttgtaatatgattttataagtgtatttagaatatgtttgtgtaaatttatggttagatgatgaagttaagaaaagtttgagtttatttttggagagtaagaaattagtatattttttttatatagtattttgtatatagtataggtttaatagatatatttaaattgaattgaagtgaatattattagaattgaaagtggtagttttagattttttaggtttaaggtttagattttataagtgtttttgattattttttttttattttatttattgtaaagagtagaggttaggaaaaggatgaataattaatgattttaaaatttaggtgagaataaaaattagttttgagaaattgtgtgatatttatattttggtatttgagttttagattattttgtatgtgtattttttttgtataaagtttaggaggttatttttatattattggggtaaattttttaatagttttgggtattaaatagtttttagtaggtgtttttaaatttttttatttgttttaatttttaggttgttaggggaagtttggttgataagtttatatttttgggtagattgagtaatagtaggtggtggtttttggataagaggtgttttaggttggaaggaaataaatgagattatgattagttaaagtttggtaaagtaagagatgtttttaatttgatgattagatggtggttttgtagtatagatttttttggatggtggaatttttaattggttttgatgtagttttgtttttatttagattatgtttattaattattgtttttttttttttaggttttgtttggagtttgttttttttaaagtatgttttatttgattttgatattgttgggtttagtttgttgggtttagtttgtggagtgtttgtgtattttttgagttgttgtggtattgtttaaatttgaatgggggaaagagggaattttatattttttatagattttgttatagtgattttgtgtgtttttttagagttggttttgttttttgtggttttgagaattttggtttttggttttttaatgtggtttaagtgtgtaggttttaagttaggtgatttttgggtagttttagttttagtattgggtttttgtgttgagttttgggattatagttggggaggtggggtttttttttggggtggttgtgttggtagtggatgtgggaagttggattttgggtgttatgtattataagtttagtggttttatgtagaagttggtaggagtatgggttttggaggtttatagtttgtaggtatgagtggtgtttggttagtttggatatgagaagtggtggttttagttttggtgataggtagttgtggtgttggagttaggggaggtttttgtttgtggttgagtttgtttttgttttttttgtattttttggggtttttttatattagtgtatggtggttattgaggtttttttttgtgtatttgtttatttggtgggggttggtttggtgtggaagtttggtttggtttattgtaggggttaaggtgatttttggggttatttgtttaaaagggatggtttgtgggggtttttagtgtgatttgagttagaggtttggtttttttttttaatttgaagatatttggtttttggtttttttgttgtttgttatttgttagagttttataggtagttttatttgagtttgagattagagagtgtggggttataaaggtgtttagagaaattatggtgtagggggttggggggttatgatttgggttgggaaatttaataggttatttaatatgtttagggagggaagttgtatgtagtgaggttatatttttttgattgtaaaatatttgatagatgtttgttgtttgggttgtttgaaaagtattttattttatgtagattttattaattggagtttgattttttagtatgtgttgggggtaaatatgagggattttagagttttagatgtgtttttttaaattatggtgttttttgttttaattgtgtgattttggttaagttatttaatttattgtgagtttagttttatttagggtggtgttagtatatattaaatgaagtgtgttaagtgattagtagtttgggtaggtggttggttttggataagtgttaattgtttattagaagttgtttgagatagtatatttttttttaattttttagagaagtgtgggaagtgttggtgagatatgtagttagattgtagtagtgaggggtttagatgaggtgtaaaggatattttattattgttgttttattttttttttttgtgggatattgtagtttgtttaagaggtagatgtttaagaaagattttaggtttggtattgtggtttatgtttgtaaattatagtattttggaaggttgaggttgagggttgtttgagtttaggagtttgagattagtttggggtaatatagtgagattttgtttttaaaaataaaaatagatgattttaattttagataagaagggtaagtttttttttttttttttgggggttagtgggggagttgtggtgggaatgggaaggaagagtttagggtttataaatgttgagtttgtgatatgttatgtttggtagtagttagatttttgaatatggagtttaataaatttgggtgtttttagtttataggtggtaatttgtagggaagaaaggttggattatagttagagtatagaaatatgagggaagggtggagaaggagaatgtgtttaaagaatagtttggatgagaagggaaattagtgtggttttattgaaattgaattggtaatgatttgtaaggaaggaatagttagtagtgttgtattttttttatagattatgtgagaaaatggttatttttattatttgtttttatgaaatgtattttttagtgtatggatattaaatgttatagtttgatgagtttggataaatttatgtattgtataattatattttttttaatatgtaagatgttatattattttaggaagtttttttgtattttttgttaatttttgttatttttttattttgatttttattattataaatagatagttttgtttttttttgaattttatgtaaatggaattagttttgatttaggttggagtgtaatggtatagttatagtttattgtagatttatttttgagtttaagtaattgttttgtttttgtttttgaaaatgttggaattatagatgtgagttgttgtgtttggttgtttaaaaaatatttttgaggttagtttgtgttgtatgtattagtagttaattttttttatttttttatttttttgtgggattttattttataaatatattatagtttattttgttggtggtagtagatgtttttttatttatttttttaaaatattttttgagataggtttttgttgtgttgtatagtttgattttgaattttttggtttaggtagttttgttattttagttttttgagtggttggggttatagatgtgtattattatatttggtttatgtttttttaatatatttttagtataatttaggttttgttgtttagtaagaaaaaagtaaattttttgattaaaaattggtatattgtaataaaatgggtgtttagtagagattattttgtgatgagtttgatatagatagggtttttagatttttagtatttttttttgtgaattgtgttttttttgagaatttgaattttttagttatttaaagattttttaaattatgttgaaaagaagtgatattgtgtaggttttatatgaattgtaaatttttgagtgattgtgataggtgtttttttaattaggtgttttgattttggtaattaggagtattttagttttttttttttttggaaatatatgatgaagatgtttgtaatttgtagtagtaagtaaagtgaataatttgttatgtattaaataatataatatggaaaaggtggttttgtaataattgtataggtagagatttgtaagttagtttgatagtaagtagttggtgggatggtattttttattggttgaaaggtattttttttatttttttttgaattgtgttaaaaataaattgaggttaataagtatatgaagatgtttaatatttttagttattagagtaaattataattataatgaggtattatttagtatttattagaatgtttagaattaaaaagatagatgataataagtattggtgaggatgtagagaaatgaaatatgttatatttgtggtggaaatggtaaaatgatgtagttattttggaaaatagtttggtagtttgttaaaaaaggaaatgtaattttattgtgtgatttaggaattttttttttaattaagatggtagaatggtattttaggtaaagggaattgtgagagtgaaggaagggagggggtttggaggagaagtattgggtaggtaagtttgattgtggaggatggaggtaaattatgaagggtttagtatgtaaggatttaattttgtgaggtattagtaggaagttgtagagtaatttgatgtagagttgtggtagtttgtttttttagatgagatagatgttggggatgaggagggagggttttagtatgattggtgaattggtgttttttatagtgatagggtgtttttgaatgggtttaggagtgaattttggatatgatgagtgtgaggtgttagaaggatatggaggtaggtggtgatgtttagtttattgttagaaataaatagaggttaggtgtggtggtttatattggtaattttagtgtttttggaggttagggtaggagaattgtttgaggttaggagtttgagattagtttgggtagtaaagtgagattttgtttttaaaaaaaaaataagaaaaattagttgggtatggtgaagtgtatttgtagttttagttatttaggaggttgatgtggaaggattatttgagtttaggagattgaggttgtagtgagttgtgattaatgtgttgtattttagtgtgggtgatagtgtaagatttatttataaataaaataaaataaaaagttaaatgaattgagttattgtagattgaaattggtttttagttttaaattatagtggaaaagtttatatatttttattatttaaaaattaaaattatggggatttttttttttttttatttttttttttaaatttaagaggtagaagaaaaggaaaatgttataattaatttttagagggaaaattatgtttatttttttttttaaaaatttggagtaattgaaataaattaggaagaatttaattattaaatgtggttaaggttgaatggtttgtaattaattttggaggtggggtttatttaagtagttaagagatttagtattaaaaagtaaagtatgtgattttttttgatttatgggttatttatttttaattttattttgagatagagtttttgttgtttaggttggagtatagtggtgtgattatagtttattatagttttgattgtttgggtttaagttatttttttattttagttttttaagtagttgggattataggtgtgtattattgtatttggttaattttttgatattttgtagaaataaggttttattatgttgtttaggatgattttaaatttttgagttaagtgatttttttattttagttttttaaagtggtgggattataggtatgagttattatgtttagtttgtttattttttataagaatagtttttagttgtttttttattgttatgggaattgtggatgttttgttattaaatgttagttgattagattttgtttttgagatatttaaatttatattgtgaagttatagttttttttagtttatttgaatattttgtttatatttattgaatgtgtttattttgttggttgtttttttaagttttggaatataggagtagtgaataagatgtgttaaaattttgtgtttgtggagtttttattatagtggggggagatatagtaagtaaagtaaaatatagtatgttaggtggtgataagtgttgtggagaaaaataaagagggtaagttgttagtagggtaagggggaggatatgtagtttttaaaagggtggttagaaagatttttttgaaaaggtgatttatggggttgggtaaagatttgaagaaggtgagggtataagttatgtggatatttggagaagattattttaggtagagggaatatggttgtgtttgggaggttttaggatagtttttgagttaggattatgttattgtattttagtttgagtgataaagtaagagtttagtttaaaaaggaaaaaaaatagaatgggttgggtgtggtggtttatgtttgtaattttagtattttgggaggttaaggttggtggattatttgaggttaggagtttgagattagtttggttaatatggtaaaatttagtttttatgaaaaatataaaaattagttgggtgtggtggtgtgtatttgtagttttaattatttaggaggttgagataggagaatggtttgaatttgagaggtagaggttgtagtgagttgagattgtattattgtattttagttagggtaatagagtgagattttgttttaaaaaaaaaaaaaaaaaaaaaaaaaagaatgtaggattttatattgtgattgttaaattattaaatttgaataaatattggaggaaaagttataatttataataattaatgggatgagataatgagattataggtaattttaattttataaatttttataatattataaagggaaatatggaattaatttaaaattaagatggttggtatttttgtttttagatgatattgtttaaaaattttgttgtagttttgaattattgtatgtttggataaataaatataatttttttaaaaatatttttatattagttttgttgaaatatgaatttatttttaagttatttttggagatttttggtagaaagagtttttatatttttgtatttaagaagaaatttttgtattttaaggagaaaatatggtgagtttatagaatgatataaaggagtatttaatattttttatttagtttaaattatgatttttgttagttttttgattttgatagtagagtttttgtttgtttttttgatttttttgagtttttgttttgagtgtgttgtatttttaaatgtaggttaatattttattgattaaattttttttttaaatgggttgttgtttttaagtaatagttgattgggagggtggggtgtgagttgtggaatatttaaaagttagggttttggatttgagaaaggtttgagtttgaaaatttgatttgttttttattatttgattaaaggtaagttattttttttttagtgtttttttttgaaaaatgggaatagtaatatttttatagggttgttgttagaattaagtgaagtaatgtatgtgaaatgtttgatatgatattgatattttataagggttaaatagatattagttgttgttggtttataatattaatatttatggtggttgagattgtggtaatgttatttattgtgtatttttagtgtagagtaagtgattagtaataaatgttgaatgaatgaatatgttatagaaaataggttatggtttatttttatttattgtattgtgttagaagaaatagaagttaagtttattttaatgtttttttttattgatttgtttatttagtgtttgtttggtgggagtagtattgaggtttttaatatttaatttttataatatgttttgttaattataggtaaatttagatttttttgagataagaattagtggattgattattgtatttgggtaagaggtttttttttttgtttgtaaaaggaaaaggttgggtttgaattatgttttttgattttaaatttttattttttttagttagaatttaatataaaaggaggatttttattggtttataatttttagttttttattttaatttataggttattttggattattttatatatttgttattgtaggtttattttttttagataaaaaaattagagattttttttatttttttttaaagtagttttattgagatataatttatatagtatataagttgtttatttaaagggtataatttagggttttttagtgtatttatagatatatgtaattattattatagttaattttagagtatttttttaattattttaaatggatatttatgtattttttaattgttatttttttagtttttaagtttttatttgaagtaattattaatttattttttgtttttgtggtttttttttttgattttgttgtgaatggtgttatatagtatgtggtttttgggattggtttttttgatttagtgtaatgttttagaggtttatttgtgttgtagtatgtgttagtatttttttttttttattttgtttaaatttttattgtatgtgtttttaatttatgtgtttatttatgttgaaaagtttattttgaaaagttttttgttttgattttgttttttggttttggaaggtaagtattgtttgtttgtttgtttagttttgttttaaattagtaagtttgttttatattgaatatttttttattgtgtgtttggaaaagtttttgaagtttgttttggggttagatattttatgttattagattagtttatttagaagaaaaaaatggtagatagattttttatgaaagttaatgataagtttgtaatagattataaatgttttattggttgttaagaagatagatatattaggtatttttggaagtttagattgggtttttgttggtgtttttttgatttttatatgttttttgtaattgtaatggtaaggggtttttgatagggtttgttttgggaaagttggagagatttttttgtttttttgtagttgaatggttgtttttattattttagatagtttttttagatatatttttaatttgttatttttttttttttttttatagg

SEQ ID NO: 730 - DNA, 9859 bp, Artificial Sequence
  chemically treated genomic DNA (Homo sapiens)
tttgtagagaaaaaaaggaaaatggtaagttgaaagtatgtttgaggaggttgtttggaatagtggaggtagttatttaattatgagagagtaagaaagtttttttaatttttttagagtaaattttgttaagaattttttgttattatgattgtagggggtgtgtgagggttagggggatgttaataaaggtttaatttgagtttttagaaatatttggtgtgtttatttttttagtaattagtaaaatatttataatttgttatgaatttgttattagtttttatgagggatttgtttgttattttttttttttaaatgagttaatttagtaatatggaatgtttaattttagagtagattttagaaatttttttagatatataataaagaaatatttaatgtggaataggtttattggtttaaaataaaattaaataaataaataaataatatttgttttttaggattagaaaataaaattaaaataaaaaattttttgaaatgaattttttagtataaataaatatataaattgaaaatatatatagtaaaaatttaaataaggtgaaggggaggaagtattgatatatgttataatatggataagtttttaaaatattatgttgagttaaagaaattagttttaaagattatatattgtatgatgttatttatagtaaagttagaagagggaattgtagagatagaaggtaggttaatggttgttttaggtgggggtttgggggttagggaggtaatagttaaaaggtatataggtatttatttgaggtgattaaaaaaatgttttaaaattaattgtggtggtagttgtatatatttgtgaatatattaaaaaattttaaattgtattttttaaatgggtaatttgtatgttatgtaaattatattttaataaagttgttttaaaaaaaggtgggggggatttttggtttttttatttgaaaggaataaatttatagtgataaatatatagagtaatttaaaataatttgtaaattaaaataaggagttaagagttataagttaataaaaattttttttttatgttaaattttaattaagaaaaataaaaatttaaagttagaaagtataatttaaatttagttttttttttttatagataaagaaggaaattttttgtttaaatatagtgattagtttgttgatttttgttttaaagaaatttaaatttatttataattgatagggtatattataaagattagatattgaaaattttaatgttatttttattaggtaagtattagatgaataggttaataaaaagaagtattaaagtaaatttggtttttattttttttgatatagtatagtaaatgggaatgaattatggtttgttttttgtaatgtatttatttatttaatatttattattgattatttgttttatattagaaatatataatgaataatattgttatagttttagttattatggatattaatgttataaattaatagtagttaatatttatttaatttttgtgaagtgttagtattatgttaaatattttatatgtattattttatttaattttgatagtaattttatgaagatattattatttttattttttagaggaaaatattggagagagaataatttgtttttgattaaatagtgaaaagtaagttaagtttttaaatttaggttttttttaagtttagagttttggtttttaagtattttataatttatattttatttttttaattaattattgtttaaaaataatagtttatttaaagagaaagtttggttagtaagatgttggtttatatttagaaatataatatatttaaaatagagatttagaggagttagagaggtaaataggggttttattattaagattaaaaggttaataagaattatggtttgaattggatggagaatgttagatatttttttatattattttgtgagtttattatattttttttttgaaatgtaaaaatttttttttgaatgtaaaaatgtaaaaattttttttattaaggatttttaaaaatggtttgaaagtaaatttatgttttgataggattaatgtgagagtatttttgaagggattgtatttgtttgtttaagtatgtagtgatttaaaattatagtaaagtttttgaatagtattatttgaaaataggaatattaattattttaattttaaattaattttgtatttttttttataatattgtaaaagtttatagaattgaagttatttataattttattattttattttattaattgttataaattgtaattttttttttaatgtttatttaggtttaataatttaatagttatagtgtaaaattttatgtttttttttttttttttttttttttttttgagatggaattttgttttgttgttttggttggagtgtagtggtgtaattttggtttattgtaatttttgttttttaggtttaagttatttttttgttttagttttttgagtagttgggattataggtgtatgttattatgtttagttaatttttgtattttttatagagattgggttttgttatgttggttaggttggttttgaatttttgattttaggtgatttattaattttggttttttaaagtgttgggattataggtgtgagttattatatttggtttattttgtttttttttttttttgagttaggtttttgttttgttatttaggttggagtgtagtggtgtgattttggtttaggagttattttgaaattttttaggtatagttatgttttttttgtttagaatgattttttttaggtatttatgtggtttatatttttattttttttaggtttttatttaattttataagttatttttttagagagatttttttgattatttttttaaaaattgtatgtttttttttttgttttattaataatttattttttttatttttttttatagtatttattattatttaatatattatgttttattttgtttattgtgtttttttttattataatggaagttttataagtataggattttggtatattttgtttattgtttttatattttaagatttagaaaagtaattggtagagtaagtgtatttagtaaatataggtagaatgtttaaataaattaaagaaggttatagttttatagtgtaggtttgagtattttagaaataaagtttgattaattggtatttgatggtagggtatttataatttttatagtaataagaaaataattgaaagttgtttttataaaaagtggataggttgggtgtaatggtttatgtttgtggttttattattttgggaggttgaggtgggagaattatttgatttaggagtttgagattattttgggtaatgtagtgagattttgtttttataaaatattaaaaaattagttaggtatagtggtgtatatttgtggttttagttatttaggaggttgaggtgggaagatgatttgagtttaggtggttgaggttgtagtgagttgtgattatgttattgtattttagtttgggtgatagagattttgttttaaaataaaattaaaaataagtggtttatagattaagaaaaattatatattttattttttaatattgaattttttagttgtttaaataagttttatttttaaaattaattatgagttatttaattttaattatgtttagtaattaagttttttttagtttattttaattgttttaaatttttaaagagaaaagtaaatatgattttttttttaaaagttggttgtaatatttttttttttttttattttttaggtttggggaagagggtggagagaaaagaggatttttataattttaatttttaaatgatagaaatgtatgaatttttttattgtgatttaggattggagattagttttaatttgtagtgatttaatttatttggttttttgttttgttttgtttatagatagattttatattgttatttatgttggagtgtaatgtattgattatagtttattgtagttttaattttttaggtttaagtgatttttttgtgttagttttttgagtagttaggattataagtatgttttattatatttagttaattttttttattttttttttagagatggggttttattttgttgtttaggttggttttaaatttttggttttaagtaatttttttgttttggtttttggaaatattgggattattagtgtgagttattgtatttgatttttatttatttttaatggtaagttagatattattatttatttttatgtttttttgatattttatatttattatgtttaaaatttatttttaagtttatttaggaatattttgttattgtgaaaagtattaatttattaattatgttgaagttttttttttttatttttaatatttgttttatttgaaaggataaattattataattttgtattaagttgttttgtaattttttattagtgttttataaaattaagtttttatatattaggttttttatgatttatttttattttttatagttaaatttatttatttaatgttttttttttagattttttttttttttttatttttatagttttttttatttagaatattattttgttattttaattgggagaggaatttttagattatatagtaaaattatgtttttttttttaataaattgttaaattgttttttaaagtggttgtgttattttattatttttattataaatgtaatatgttttgtttttttatatttttattaatatttgttattatttgtttttttgattttaggtattttggtggatattaaatggtattttattgtggttgtgatttgttttaataattgaaaatgttaaatatttttatgtgtttattggttttaatttatttttgatgtaatttagagaaaggtaaggaagatgttttttaattaatggaaaatgttattttattaattgtttgttgttaagttgatttataaatttttatttgtgtaattgttatagaattattttttttatattatgttatttagtgtatggtaaattatttattttatttattattataaattataaatatttttattgtatgtttttaggaaaggaaaaagttgaagtatttttaattattaaagttagagtatttagttgggagggtatttgttataattatttagaaatttataatttatataaagtttatatagtattatttttttttaatatagtttaagaaatttttaagtaattaagaagtttaaatttttaagagaaatatgatttatgaggagaggtattagaaatttgaaagttttatttatattaaatttattgtaaggtaatttttgttgagtgtttattttattataatatgttagtttttagttgaaaaatttattttttttttattaagtaataaaatttagattatgttgaagatatattaaaagaatataaattaagtgtggtggtatatatttgtaattttagttatttagggggttgaggtgataggattgtttgagttggggagtttgagattaggttgtgtaatatagtaagaatttgttttaaaaaatattttaaaaaaataaataaaagaatatttattattattaatagaataaattgtgatatatttataaaatgaaattttatagaagaataagaggataaaaggaattaattattgatatgtataatatggattaattttaaaaatattttttgagtagttagatatggtggtttatatttgtaattttaatatttttagaggtaaaagtaggatgattatttgagtttaggagtgagtttatagtgaattgtgattgtgttattgtattttagtttgggttagagttggttttatttatatgaagtttaaaaaaaggtaaaattatttatttatgatgataaaagttagaataagaaggtggtagggattgatagagggtataagggaattttttgggatgatgtaatattttgtatattgagggaggtgtggttatatagtatatgggtttgtttaaatttattaaattgtaatatttaatatttatatattggagaatatattttatagaagtagatgatagaaatggttatttttttatataatttgtaaaagaagtgtaatattgttgattattttttttttataagttattattaatttggttttagtgagattatattggtttttttttttatttggattattttttaaatatattttttttttttattttttttttatgtttttatattttaattataatttaattttttttttttataaattattatttatgggttgaagatatttaagtttattaaattttatatttaaaaatttagttgttattaagtatgatatattataaatttaatatttataaattttaaattttttttttttgtttttattgtaatttttttattaatttttgaaaaaaaaaaaaaaaatttgttttttttatttgagattagaattatttgtttttgtttttagagatagggttttattatgttgttttaggttgattttaaatttttgggtttaagtgatttttggttttggttttttaaagtgttgtgatttataggtgtgagttatggtattagatttgaaattttttttaaatatttgttttttgggtaagttgtagtgttttatagaaaaaggaaatgaagtaatagtaatggagtattttttatattttatttgggttttttattattgtagtttaattgtgtattttattgatattttttatatttttttagaggattaggagggaatatattattttagatagtttttggtgaatagttaatatttatttagaattaattatttgtttaaattgttagttatttgatatattttatttaatgtgtattaatgttgttttggatgaaattgagtttataataaattaaataatttggttaaggttatataattaaagtggaaaatgttatgatttgaaaaggtatgtttggggttttaaaattttttatgtttatttttaatatatgttggagagttaaattttaattggtagaatttgtgtgaaatggaatattttttagataatttaaataatgagtatttgttaaatattttataattgggaaagtgtaattttgttgtatgtaatttttttttttggatgtgttaagtaatttgttaaattttttaatttagattatagttttttaattttttgtattatggtttttttaaatgtttttatagttttgtgttttttaattttgagtttaagtgaggttgtttatggggttttggtagatgataaatgataaggaggttgaaagttagatgtttttgaattgagggagaaggttggatttttgatttgggttatattggggatttttataaattattttttttagataagtgattttgggggttattttgatttttgtagtgagttagattaaatttttatgttaggttagtttttgttaggtgagtaggtatataaaaagaagttttagtgattattgtatgttggtgtggagaggttttgggaggtgtaaggagaatagagatgaatttgattgtgggtagaagttttttttggttttaatgttgtgattgtttgttgttgaggttagggttgttattttttatgtttgagttggttaggtgttatttgtatttgtgggttataggtttttgaagtttatgtttttgttaatttttgtgtgaagttattaaatttgtagtatatgatgtttagagtttggttttttgtatttgttgttaatgtgattgttttagagaaggattttgtttttttggttgtggttttgagatttagtgtaaggatttggtgttgggattagggttgtttgaagattgtttaatttaaaatttgtatatttaagttgtattggggaattaaaagttagggtttttaggattatgaaaggtaaaattagttttaagagagtatgtaaagttgttgtggtggagtttgtaggaaatatgaagtttttttttttttttatttagatttgggtagtgttatgataatttaagaaatgtgtaagtgttttatggattaagtttggtggattaagtttggtagtgttggagttaggtggagtatgttttaggaggggtgggttttaggtggggtttgggggggagagggtggtgattggtgggtgtggtttgggtaggggtggggttatattgaagttggttgggaattttattatttgagagagtttgtgttgtggagttattgtttggttgttgggttgaaggtgttttttgttttattgaattttaattgattgtagttttatttatttttttttgatttagagtattttttatttagaagttattatttgttgttgtttagtttgtttaggagtatagatttgttggttaagttttttttggtaatttgggagttgaagtaaataagaaaatttggaagtatttgttgaaggttgtttagtatttagggttgttgggagatttgttttaataatataaaagtagttttttgggttttgtgtagaggaaatatatatgtagagtgatttaaagtttaggtattaggatgtaaatgttatatggttttttagaattggtttttatttttatttgagttttaaggttattgattatttattttttttttggtttttgttttttgtgataaatgaggtagggggagggtgattagaaatatttgtaaaatttggattttgagtttgaaagatttggaattattatttttagttttggtagtatttgttttagtttaatttaaatatgtttgttaagtttgtgttgtgtgtaaggtattgtgtaaaaggagtatattagttttttattttttagggatggatttaggttttttttagttttattatttaattataggtttatataagtatattttagatgtatttatgaaattatgttgtaaattgatggatgatattaatttatatatagtattgttttaaatttatttaatttttataataattttataaggtaaatgttattattatttttattttagaatataggaaaatgatgtttggagaagttaagtaatttgtttaggttagggataagtggtagagttaggtatttggtttaagattttttattgttaagtattatgttataaataaatagatatgaagttattttgaaaagaggaggattaaggttgagtattttagggtgagggtgtatattagtattttggttgtaggtttatgtttaagagttttaagtatttagtattgttaatatgttgtaaaggttttagtgaatttatgtaagttagtttaaagttgttatttttataaagagatattgtgatataatggaaagaatatgtaatttgggtttatgtttatatttttttaaggataagtggtttgggattagtgatttttttttttttttttttttttttaaattttttttgaaatagggttttattttgttttaggttggagtatagtggtgtgattttggtttattgtagttttgattttttaggttgaggtgatttttttattttagttttttgggtagttggaattatagatgtgtgttattatgtttggttaattttttgtatttttagtagagatggggttttattatgttttttaggttagttttaaatttttgggtttaagtgatttgttaaatttaagatttttaaaatgttgggattataggtatgagttattgtgttaggtttattttatgttttgatattgaatag

SEQ ID NO: 731 - DNA, 4022 bp, Artificial Sequence
  chemically treated genomic DNA (Homo sapiens)
  unsure (1005, 1015, 2239, 2651, 2724): unknown base
gattagagtagtttaggtggatggatataggggtttgtggtaaaggtgagtaatttaggtttagaaatttttaattttataagaaggtattagtaaatttgtttagtttttgtatttgatggagatattatttttataattgggttgaaagtagatttattttggaggaatatattgtatttattgttttgaatagtaaataaatttgttgtaaaatagatgttaattttattatttaaggtagtaagtaaatttagatttgaaggtgatattattttgtaaggttatttgttgtataaatatgtttgaaaagatggtttagaaaagaaaatggtattattgtttttgtttagaagatatatagaaatataagagaattatggaaaattgttttttaatattgtttatttagagttttttatttttgtttgtaggatagttttaatattttattattagtgtgtttattatatttggttttattgtgtttaattaagatttttagttttagttttttattatgtttggtagtgttttattgttaattttagaataagggagtgtttagaattttgaggggatatgggtggggattagaatttttgggtttgagtgtagagggggtttatattttttggttttgaaggaggaagaggttggaggtgaatgtttttggaggggaggaatgtgggttttgaatttttaaatttttaagggaggagattggtaaggttttagtttttgaggtattgatgtgggaatggtttgagaggtttaagaattttgtatttttgggaagaaggggttgaaattgtgaggggttgagttgtaggggtttgttagtttgagattttttggtgggttttttgggaagtaaggattggaattattggttttagggtttggtgtgaaggtaatgggattttttgatttttaaagggttagaggattgaggattgtttatgtttgattttttttatttaatttttaattttaattgagggnaattatttantttttttagttttataagagtgtgtttgtgtgagtataatttgtaatatgtgttatgttttgaggtttggggtattatttaatttattatttagtatttgtgttatgtgggtgaggttggtgttatgatgttatgtagttgtgattatttttgtagtgtgttttttttgttatgttttaattatggagttgtggatgtgtgttttttggtggatgtggtttgtgtggtgttaggttggggtttggtgtttgataaagattttagaattataggaaattaggattgaaaggtgttagagaatggttatatgttgttgtttatgaaattttaaggatttttgggtggagggtataggagtttgaatttatgggtttgttttagtttattgtttttttaagtgagttttttagatatgaggtattgtgttagtattagttttatttgtattatattttgtaatagggattatttaggattttgatgaatattatgttgtgtgtaggaagaggggtgaaggtatgaatttttgtgtgtttagagtttagaggggtttatgatgggtggggaggaggttgtggattggtttgagaagtgggatgtggttgtgtttgattttttttggttagataaagtgttggatatagtattgaaaatggagtatgaagattagttagaatggagggttaggttggagttgagttatagatggggtaaaattttgttttggatgagtttggggattggtaatttaaaggtggtttgggatggtatggttttgggatggaaataggtttgtttttatgttggttgggaagggtgtggggattgaattggggatgaagtaggtttagttttggagatagaatatatggaggtggttattgtatgtgaggatgtgtattagtttggtttgatttttaaatgaaggaagttattagggttgttttgaattagattaagttgtgttgggttgatgggttgggtttgtgggtgatgtggttggattgggttgtgttaaattggtttgggttaggttttggttgaggttattatggggatgaggatatgtttgggatattggatttaggtggtttttatttaagttgaggtaaatttttttttagatggttattttagggaatgagtggttgtgtgggggaaattaggttattggttgtgaatatttttttattttggttttgaattgtgattatttatgtttanttttgttttttttattgtatttggagttgatttggttatttagttggaaatgggggaagattttgttaaatttttgagatatagttgggtttggattagtgtaagttgttttggttttattgaatagatgaaattatattttttttttaaaattaaataaattttatagagttaatagtggatttttataataagagttaatgttaggattttttatttttgatttttttttgagatattaaaatgagattttttaatgttattttaatttttttttttttttttttttttttttttttttttgagatatagtttgggttttttgttttgttatttaggttggagtgtagtggtgtgattatagtttattgaattttgattttttgggatttaagggatttttttgttttanttttttgagtagatggggttataggtgtttgttattatatttggttaattaaattttttttttttttttgtanagaaagggttttattttgttgttttggttgattttgaatttttgattttaagtgattttttagttttggatttttaaagtattgggattgttggtatgagttatttattgtgtttggtttgtagtttaattttggagtgtataaatttggtttttgatagttagatattttagtgagaaggaggtgttggattttgtatgaggataattttgatttaggagggtaggttaataggaatttttgttgtatttgtatgttgtataggtatggagaatgaggagtgaggagttattggaattttatattgtttagtggatattggattttgaaataatagggaatttggtttgggagagttatatttttggattggataatatgtggtattataaggttttatgatgagggagaaatgtatgtggggaattattttttgagtgtggaagtgtaagaattagagagtattgaatgttaatgtttttattttaggaatatggtaagttggaggtttagtttttgggtttagatgggtatagggattaggaagttttataatttgattattttgatattttagggtatattagtttggggtgtaaaggaagtatttgggatttaggtatatgagattttgtattgaaaattaatgattggggttggttgtggtggtttatgtttgtaattttattattttgggagattgaagtgggaggatggtttgagtttaggagttggagattagtttaggtaatatagttagattttttttttataaaaaaattaaaaattagttggatgtgatggtgtatgtttgtggttttagttattttggaggttgagataggagaattggttgagtttgggagtttaaggttatagggagttgtgattatgttgttgtattttagtttgggaaatagagtgagattgttttagaatttttttaaaaaagaattatgattattttaatttttgttgttgtttattttgagtttgttttttttggttttgttttttagattatatttttatgatttataggttttgtttaatttgattttatattgtgagaatgtttttagattgatttagtatgtgtggaatagtaagtgttggttttttttttttttttatagttttgggtgtgggagggggttgtttagtttttagtagtatggggagggttttggttagtatttaggtgttaatagggtaagggtggggttttggagaatgaaggttttatagggttttttagggaggttttttagttttaaattgtattatttggttgtgga

SEQ ID NO: 732 - DNA, 4022 bp, Artificial Sequence
  chemically treated genomic DNA (Homo sapiens)
  unsure (1299, 1372, 1784, 3008, 3018): unknown base
tttatggttaggtggtgtagtttggggttggggggtttttttgaggagttttataaagtttttattttttaggattttgtttttgttttgttggtatttagatgttgattaaggttttttttatgttgttggaggttggataatttttttttatatttagagttgtggaaggggagggagagttagtatttgttgttttatatatattagattagtttggaggtatttttatggtgtgaggttagattgggtagggtttatggattatggagatgtgatttagggaataaagttagagaaggtaggtttaggatgaatagtaataggggttgggatgattatgatttttttttaaaaaaattttgagatagttttattttgttttttaggttggagtgtagtggtgtgattgtagttttttgtagttttgaatttttagatttaattgatttttttgttttagtttttaggatagttgagattataagtatgtattattatatttagttaatttttaatttttttgtagagagagggtttggttatgttgtttaggttggtttttaatttttgggtttaagttatttttttattttggttttttaaagtgatgagattataggtatgagttattatggttagttttaattattgatttttaatataaagttttatgtgtttaagttttaagtattttttttgtattttaaattaatatgttttgaaatattagaatgattggattgtgagattttttggtttttatatttgtttgagtttagaagttggatttttaatttattatgtttttgaaatagaagtgttggtatttagtattttttgatttttgtatttttatatttagaaaatggttttttatatatattttttttttattataaaattttgtgatattatatattgtttaatttagaaatatgatttttttagattaagttttttattattttaaaatttaatgtttattaaataatatggggttttggtggttttttattttttattttttatgtttgtataatgtataggtatagtggggatttttgttgatttgtttttttaggttagaattgtttttatgtaaaatttaatgttttttttttattgaaatgtttagttattaggagttaggtttatatattttaagattaagttgtaagttaggtatagtgagtggtttatgttagtaattttagtgttttgggagtttaaggttgaagaattatttgaagttagaagtttaagattagttagggtaataaagtgagattttttttntataaaaaaaaaaaaaaaatttaattagttaggtgtggtggtaagtatttgtagttttatttatttaggaggntgaagtaggaggattttttaagttttaggaggttagggtttagtgagttatgattatattattgtgttttagtttgagtgatagagtaaaagatttagattgtgttttaaaaaaaaaaaaaaaaaaaaaaaaaaaaaaaagaattagggtggtattgagaaattttattttggtgttttagaaaagaattaagaataaggagttttggtgttaatttttattataagagtttattgttaattttataagatttatttgattttgaaaaaaaaatgtgattttatttgtttaataaaattagagtagtttatgttgatttagatttagttgtgttttaagaatttgataaaatttttttttatttttagttgaatgattagattaattttaagtatagtgaaggagatagaantggatatagataattataatttaagattaggatagagggatatttatagttagtggtttgattttttttatataattatttgttttttggaatgattgtttgaaaggaaatttgttttagtttgaatgagaattatttgaatttagtgttttaagtatatttttatttttatgataattttaattaaaatttgatttaaattaatttaatatagtttaatttaattatattatttataagtttaatttattaatttaatataatttaatttaatttaagataattttaatagttttttttatttaaagattaaattaaattaatgtatatttttgtatgtaatagttatttttatgtattttatttttaaaattaaatttattttatttttaatttaatttttatattttttttagttaatataaaaataaatttatttttattttaaagttatgttattttaaattatttttaaattgttaatttttaaatttatttgaagtagaattttattttatttgtaatttaattttaatttgattttttattttaattggtttttatattttgtttttaatgttatatttagtattttatttggttaaaggaaattaaatataattatattttattttttgagttagtttatagttttttttttatttgttatgggtttttttgggttttgaatatataaggatttatgtttttatttttttttttgtatataatatggtgtttattagggttttgggtagtttttgttataagatgtggtatagatgaagttgatgttggtatagtgttttgtatttgggagatttatttgggaggatagtggattggggtaaatttgtaagtttaggtttttgtgttttttatttagaagtttttgagattttatggatagtgatatatggttattttttagtattttttagttttggttttttgtggttttaggatttttattggatattaggttttggtttggtattatgtaggttatatttattaggggatgtatgtttatagttttatggttgggatgtgatgggagaggtgtgttgtagggatagttgtagttatatgatgttatggtgttggttttgtttgtatagtgtagatgttgaatgatgaattggatgatgttttaggttttgggatatggtatatgttgtagattatatttgtgtaggtgtatttttgtggaattagaaagantaggtaattntttttaattggaattaaggattaaatggaaaagattaaatatgggtaatttttagttttttgattttttgagaattaggagattttattatttttatattaaattttggagttaatggttttagtttttgttttttaggggatttattaaggagttttaagttaataaatttttgtaatttaattttttataattttagttttttttttttgaggatatgggatttttagattttttaggttatttttatgttagtattttggaagttgggattttattagtttttttttttggggatttaagagtttagaatttatattttttttttttaaggatatttatttttagttttttttttttttggaattaaggagtatgggttttttttgtatttaagtttagaagttttgatttttatttatgtttttttggaattttgagtatttttttattttggggttggtaatggggtattgttaaatatggtggggaattggaattaaaaattttggttaggtatggtgaagttagatgtggtagatatattaatgatgggatgttaagattgttttgtagataagagtggaaggttttgggtgaatagtgttgggagataattttttatggtttttttatgtttttgtgtgttttttgagtaaaggtaataatattgtttttttttttggattatttttttaagtatatttgtatagtagatagttttgtaagatggtattgtttttagatttaggtttgtttattgttttagataataaagttaatgtttattttatagtagatttgtttattgtttaggataataaatataatatgtttttttagagtaggtttgtttttaatttaattataaagataatatttttgttagatataaagattggataagtttgttagtatttttttataagattgaggatttttaagtttaggttgtttatttttgttataaatttttgtgtttatttatttgaattgttttgatt

SEQ ID NO: 733 - DNA, 3326 bp, Artificial Sequence
  chemically treated genomic DNA (Homo sapiens)
tttttttattgtgtttggagtttatttgattatttaattagaaataggggaagattttattaaattttttttttttttttttttttttttgagatagagttttattttgttgtttaggttggagtgtagtggtgtagttttggtttattgtaatttttgttttttaggtttaagtgatttttttgttttagttttttgagttgttgggattataggtatgtagtattatgtttagttaatttttgtatttttagtagagatggggttttattaatgtttgttaggttggttttgaatttttgatttggtgatttatttgttttagttttttaaagtgttgggattataggtgttagttattgtgtttagttatttttgttaaatttttgagatatagtttgggttggattaagtgagttattttggttttattgaatagttgaaataattaattttttggaaattgatgaaattttatggagttaatagtggaggtattagggtttttaagagtttttgatttttttttgagattataaattgtgattttgtatgttattttaatttttttttttttttttttaaattgaggttttagttttattttattttttaggttggagtttaatggtgtgattatagtttattgtagttttgaatttttggttttaagagatttttttgttttggttttttaatagttaagattatagtagtttattattatatttagataatttttaaattttttggggggttgggtatagtggtttatgtttgtaattttaatattatgggaggttgagatgggtggattatgaggttaggagtttgagattagtttgattaatatggtgaaattttgtttttattaaaaaaaaaaaaaatagaaaaattagttgggtgtggtggtatatggtatttgtaattttagttattgaggaggttgaggtaggagaattatttgaatttagaaggtagaggttgtaatgagttgagattgtgttattgtattttagtttgggtgatagagtgagattttgttttaaaaaaaaaaaattttttttttttttttgtagagatggattttgttttgtttttttggttggttttgaatttttggttttaagtgatttttttattttggttttggaaagtgttgggattataggtgtgagttattatgattgatttgttgtttaattttgaggtatataaatttggtttttaaaggttaaatattttgttggagaaggggtattggattttgtatgaggatgattttgatttgggagggtaggttagtaggtatttttgttgtatagatagagtgtataggtttggagaataaggagtggggggttattggaattttatattgtttgttgtatgttggattttgaaatgttagggaattttgggagatttatatttttgggttagaggatttgtggattataagatttttttatgatgatagtagtaatgtatttgtggagttggattttgggttgggagtgtaaggaaaagaatgtattaaatgttaagatatttattttaggagtatgaggaataaaagttttagtttttggttttagagtggtgtagggattagggagttttataattttttgagtgttggtgttttagggtatattgggttttggagtgtaaaggatttaggtatgtgaggttttgtatgaagaattggggattgtatttattttttgtttttgttttattttgggtgtgttttttttgtttttgttttttagatgaagtttttatgagttatagggtttggtgtatttagggtgatttagtaattgtagaatagtaagtgttagttttttttttttttttatagttttgggtgtgggagggggttgtttagtttttagtagtatggggagggttttggttagtttttgggtgttagtagggtaggggtggagttttggggaatgaaggttttatagggtttttgggggaggttttttagttttaagtttattatttgtatttggagagttgtgttattatgtgggttttggttgttttttttattttgtttgtgatgtggattggtgagaggggttatggttggggggatgtaggagagggagttagttttgattgttaagttgaggtttttttttttttaatttagtattttagtttagatagggagttgggtttttttttgttttttttagttttattttaagtttatatttttagtttttttatattgtaatagtttttatttttatattaggtttttgtttttttttatttattttagaattttttttttattgtttagttagttttttgtttttagttgttttattaaaggggaagtttttgggtatttttgtgtttttttttgtggggtttaaaatttttaaggattttttttaatgttattggttttttggattgtattattggtttattttttgagttttttaattttattatagtttattgattttttttatttagttgtgagtgtttaattttattttagagattttgatgtttggttttttaattttgttttaggatatttagatgttaattagatatttttttttttttagttaggttatttggtttgagataataaatgggttttttagtttggtaatgggattttgagaattttttattttttgatttttagttttagattttttatttagtggtttatattttttttaggaaaaatatgagtatttttagttataattgttagttttttgattttttaaatttgtattttttttaaaatttaaaaataaaaagaaaaataaataaaataaaattaatttagattagaattgtttttttaatttgggattttttaaattttttaaaattttttttttttagtaattgaattttgttataaggtatttatttttggtttttagtattgtttatttttttagaatttataatttgtattaagtttttttttttttagtttaagattttaaattattataaaggatttaatttttagatttaagatatggtttgggtgttgttttgtgttttttattttgatttttgggtttaattttgtttttagagtatgaagtttttttattagtattagttattaatttgtaaatttagggaagattgatagaatttttagttttttttagttttttttgtttatgttttaggatttttagttttggttttttgtttttgtgtttttttaaatttatattttaaatttattttttatttgagttttttagttttttttgttaattttgatttttttgatttagtattttttttgtagg

SEQ ID NO: 734 - DNA, 3326 bp, Artificial Sequence
  chemically treated genomic DNA (Homo sapiens)
tttgtagagggggtgttagattaggggaattagggttgataggaggaattgggggatttggataggagatggatttaggatgtgggtttgaaaagatatgggggtagagaattaaggttgggagttttgggatatgggtagggggagttgggaaaggttgggaattttgttaattttttttaggtttgtaggttggtggttggtgttggtggagaggttttatgttttgggagtagagttgaatttagggattagggtaggagatataagatagtgtttagattatattttgagtttggggattgggttttttgtggtgatttggggttttggattgggagaagggaaatttggtataagttgtggattttgaggggataagtggtgttaggaattagggataagtgttttatggtgaggtttagttgttggaagaggaaggttttggaaagtttaggaagttttaggttgagaaaatagttttggtttgagttggttttgttttatttgtttttttttttgtttttaggttttgaaaaggatgtagatttggggaattagagagttggtagttgtggttggggatgtttatgttttttttaaggaaaatgtgggttattgaatgaagagtttggggttaagagttagggaatgaggagtttttagagttttattgttagattgagggatttatttgttgttttaggttagatagtttggttaggaagaaggaggtgtttggttggtatttgggtattttagggtaagattgggaggttaagtattaaggtttttgggatagggttgggtatttatagttgaatgggaaaagttagtagattgtgataggattgaggggtttaggaggtggattagtgatatggtttaaggaattaatggtattgagagaggtttttggaggttttgagttttataaagagaaatatggagatgtttaggaattttttttttagtaaagtagttgggagtagggagttggttgggtaatggggagaaagttttggggtaagtgggagggagtggggatttggtgtgggagtgaggattgttgtaatatggaggggttgggggtatgggtttggagtggggttgggagagatagaaaagagtttagttttttgtttgggttggggtgttgggttgggggggaaagagttttagtttgatagttagggttggtttttttttttgtatttttttaattatggttttttttattaatttatgttatggatagggtgaggaagataattgggatttatatggtgatatagttttttgggtgtaggtggtaagtttggggttggggagttttttttaggagttttataaaatttttattttttaggattttgtttttgttttgttggtatttagaggttgattaaggttttttttatgttgttggaggttggataatttttttttatatttagagttgtggaaggggagggagagttagtatttgttgttttgtaattattagattattttggatgtattaggttttgtagtttatggagattttatttaggggataaaggtagaggagatatgtttaggatgaaatagaaatagggggtgggtatgatttttgattttttatataaagttttatgtgtttagattttttgtattttaagatttagtgtgttttaagatattagtatttaggagattgtgagattttttgatttttgtattattttgagattagaaattagaatttttattttttatgtttttgaaatagatgttttggtatttagtatatttttttttttgtatttttaatttagaatttagttttatagatatattgttattgttattataaaaagattttgtggtttatagattttttagtttagaaatatgagttttttaaagttttttagtattttaaaatttaatgtgtagtaaataatgtggaattttaataattttttattttttgttttttagatttgtgtattttatttgtgtaatagagatgtttgttgatttgtttttttaggttagaattatttttatgtaaaatttaatgttttttttttaataaaatatttagtttttaggagttaggtttatgtattttaagattaaatgataggttagttatggtggtttatgtttgtaattttaatattttttgaggttaaggtaggaggattatttgaagttaggagtttaaggttaattagagaaataaagtaagatttatttttataaaaaaaaaaaaaaaattttttttttttgagatagagttttattttgttatttaggttggagtgtagtggtgtaattttggtttattgtaatttttgttttttgggtttaagtgatttttttgttttagtttttttagtagttgggattataggtgttgtgtgttattatgtttggttaatttttttattttttttttttttagtagagatagagttttattatgttggttaggttggttttaaatttttgattttgtgatttatttattttagttttttatggtgttgggattataggtgtgagttattgtgtttggttttttaaaaaatttaaaaattatttggatatggtggtggattattgtagttttagttattgggagattgaagtaggagaattttttaaggttaggagtttaaggttatagtgagttgtgattatgttattgaattttagtttgggaaatagaatgagattgaaattttgatttaaaaaaaaaaaaaaaaagattaaggtggtatgtaaaattataatttgtagttttagaagagaattgggaatttttaagagttttggtatttttattgttaattttgtaagattttattaatttttaaaaagttggttattttagttgtttaataaaattagagtagtttatttgatttagtttgagttgtgttttaagaatttgataaaagtggttgggtgtggtggttgatgtttgtaattttagtattttgggaggttgaggtaggtggattattaggttaggagtttgaggttagtttggtaaatattggtgaaattttatttttattaaaaatataaaaattagttgggtatggtgttgtatgtttgtaattttagtaatttaggaggttgaggtaggagaattatttgaatttgggaggtagaggttgtagtgagttgagattgtgttattgtattttagtttgggtaatagagtgagattttgttttaaaaaaaaaaaaaaaaaaaaaaagaatttgataaaatttttttttgtttttagttgagtgattaggtaaattttaagtatagtgagggag

SEQ ID NO: 735 - DNA, 9353 bp, Artificial Sequence
  chemically treated genomic DNA (Homo sapiens)
atgatgggagattattggtttagagtatgttaagattttaattattagagtgttttttaggaggattttattgaaggttttttttttttttttaaataaaattttgatatgtatatttattaaaagatgggagattaaaaattttgagattaaaaattttggtatgtgtatattttataaagattatagaggtaatgggggatgttagggggttattataatagtatgttttaattagagtgttattgttgttatagaaattttattgatataattttttatgtttgtatggtttagttaaaatattttgggtttatttatttattttatagatagggttttgttatgttgtttaggttggtttttaatttttgggtttaagtagttattttattttagttttttgagaagttgagattataggtattattttagttttagatatagttataattttatgtaattaagttgtatatttaattattattaaattaataataaagtttttgatattgagtttatgtttttaatagatgatttttttgtgtgtattaatttggttatttaaggtgtattatttttataagagattagttttttggatttggatttaggaggtttaattggtagagtaatttttaagttaagaggatttttatggaggaaggaatttgttgttttatataaagtaagtttttagttttaggtttaagtttaaattttattatttggggataaatgaatttgtttaatagtaataatttttataaaagttatatggaaaaatatttgggttagtttgttttgtataaatttttttaggagggagtatttttaaagaaagtattaaatggaaaattattggtatggagtttagagagatttggtgtttgagttattattaggtagatggagtttttaattttgtataattaggggaaagattggagggtgatggagtagaaagagtagttggggtgaggtagagtattatgaagagaggttgttggaaagaaattaaaattgtttttaaggatttttaagtgattttttttaggttattttggaaaaatgtgtgtttttatttgttaattagggtgattaatttattattttgtattttttaatttgaaatattggaagttataatattagagttaatttttttttttgtggttttttgtttgtttatttttttttttttagagagttttgataagttattgtattggaatttattgttttgatagagttttatttttttaagattgatgaaatttgttttattgattttgaatggatagttttattttttaaatttttttgagagttttggattaagtttattaaggttttttaattttaagaatattagaggatgttggtttttggtggaaggtttgttgaattatatttagtatgtatagatatagttaatatttagagtggggtgtaaagagagatttagaaggttataaaaagtttgggtaaatttatattttgtgaaggtgttttgtaaaaggattgtaagttatttttttggtatgtatttttgtttaagaataaagtgtggtaaattatatgtgtagttagtatgatttatatagattaaggataaggtatttgttagatttttaaagagtattaaattggggttggataataaaggtatttttttgggtttttaatgaaattaaaatttatttttagtttatgtatttatgggatgtttgttatttttgttaaagtatttgtttttttattagatatagtagttgaggaatttttttttgttatgtggggtgtgggtgagtgttgggggtggaaagaatttgttgttattaggattaggtggaagaagtatttttgttgatttttggggaaggttgttgtggtatttttagtgtaattaattagaaggtttttttgtgtagtggtgtgttaattgtaggtgttttttttgttgattttatgggttatttaaaggtatgtgttggggttaaggttgtattgtattgggtgggggtttggggagtgtagtagttatggtaagttgttttttgtttaataatggtgttaagatgtttattttggggttgggtatttggaaggtaggtgtttgtgggggtgtgggtttggggtttgttttatattttttgtgtggtttgtgttggtgagggattttgagtgattttgagtagtttgttttgtggatgtttggtgtgttgggagttatgtgtgggtttgtagggtttttagtgggttggggttggttttgtagagattgggggttttggttttttgggttggttttgggtgttagggtagtattttgtgagtggggtttgggagtagtttatgggagtttttgttttattgtgggtaatttttgatgggtggtttattagtttgtattttgggttttagtgggtgttttaagtggtataatgtgagagggaggtggggaaagtgggttttatagattggtggattttgggtgtagatagggatgtggagttgttggtaaggtgtgggagtgtagatttagtttttttttttttgaggtatttgtagtttggttgttttatttgtaaatagttggttttaattgttttgatttttgttttttttgaggaataagtattttaagttggtagagggtagagaattaggtggtgtgagtttgtttggatttagttgttaataaggtgtagtgtggagttttttggttaggtgttgttttggggtgttttgggtttggaatttgggagaaaaatttgggtattttgtagttagttgataatttaggaggtgttaaggttagtattttttttgtaaaattttaatattatatagtgtttttgagaagtgtttagttggatgagaatgataataggatatgaaatattataggatatgaaaaatgataatatgatatgaaaaattaaaaataatagtttgagtttgattatttgaaaattgagtaataaaggtggtggtatgggagttgaggtaaaatttagaatttttaattttttaagtattgtatattatattttatagttataatttgggttttttagtttttgtttttgttgtttgtttgtttgtttgtgatagggttttgttgtttaagttggggtgtagtggtataattatggtttattgtagtttggaatttttgggtttaagtgatttttttgttttagtattgtgggtagttgggattataggtgtttattattatatttggttaatttttttttttttttgtagagatagtttttgtttgttgtttagggtgatttttaatttttgggtttaaagtgttttttttattttgttttttaaagttataggtgtgaattatttggtaggtttatgttttaggttttttttttaaaatttgaatatgggtttgggtgttggatatttatatatagataagggaagaaaataatagaaagaattgagtgaattgtgagatgtttgaaataggatagaagagtttatatgtattttaaaatttgttgttgaaaattagtaaatataaggtaagaaaaaggttatttgtattagggagagtgttttttggttagaatgattagggtatgtgatttgttttttttaaaaattttagtggtgtttttaaggttgtaattgaattataattatgatattaagttaatttttatttgttgtatgttatgtttttggaatggatgtagaaggatgtttttttggtaatagtaaatattttttaagtatgatgtaatgtatagatatatatatgtaattggaataaaaattatttaatagtatttaatttatgtaggttgtattttaatatttttttttattttatttttttaaaaattattgttatatttttagaagttagttttgtgatttattatttgaaaattattattttagggtaaataaggagtaaaagtttatttttttttttttgagataggggtttagtgttatttaggttggagtgtagtggtatgattatgatttattgtagttttaattttttgggtttaagtggtttttatattttagttttttaagtagttgggattataggtgtgtgttattatatttgggtagtttgtttttaattttttgtagagataggtttttttatgttgtttaggttgaggagtaaaagtttatgaaagagggttttagattatttatttgagtatttaatgttttaaaaagttatgtatttgtttaagataatattatattataatatttgtatatttaggttatgtattttagtagatagagtttattgagaaattggatgtttgttttatttattattatttttagtattttttatagtgtttggtaaatataggagtaggtatttaaaagttatgtgttgaatttatatgaagaagtaaaatgattttagagatagttgtatggtgaaaatgtttatttgtatttttgtggatgaggagattaggttggtgtagaattgtatggtgggggtagtggggaatggtgggttaaagtaatggtataaggatggatttggaattaattttttttttttttttaatgatttaaaatttttttttggggttgggtgtggtggtttatatttgtaattttagtattttgggaggtagaggtgggtagattatgaggttagaagatagagattgttttggttaatatggtgaaattttgtttttattaaaaatataaaaaattagtttggtattgtggtatgtatttgtagttttagttatttgggaggttgaggtaggaaaattgtttgaattttagatgtggaggttgtagtgagttgaggttttgttattgtattttagtttgggtgatggagtaagattttatttaaaaaaataattaaataaaaaaattttttttttgtatgtgtgtatgtatttttttatagatgtttgatagaagatgtgattttttgtttgtttttgtgatagttggaggaggttttgtaggtaggtgtagttttttatttttttgggtttttttatgttgtagtggttgtgttgtattttttagatttttagtagggttttggtagtttttatttttgaaggtttttaaattttattttttttttaggtgagggttttaggtagatggggagattatttttgttttagatttatgtggtttggatagggtttttttttggtagttttgttttttatattggatagtaaataattatatttgtaattttagtattttggaaggttaaggtgggtggattatttgaggttaggagtttgagattagttggttaatatggtgaaattttttttttatttaaaaatataaaaattagtttggtatggtggtgggtgtttgtaattttagttgtttgggaggttgaggtaggagaattatttgaatttagaaggtagaggttgttatgatttgagattgtgttattgtattttagtttaggtgataagagtaaaaaaaaatttggttttagaaataataataataataaaaatttattatagtattgtaaagttaggaagtttttaaaatagagatgatgtttggtgtttattagtgttttgttattgatagtgtttttaatttagttgaaaaattgttggaggtaaaagttattgtaagttttttatgtatgtttatagaatatttttagggttgaaggtataattatgtttttttattttttgttatgattattattttttttttatttaggagttttgtgagattttttttttttttaatttgttttaaaataaaattgtaatattagagataatattgtatttttgtttatggttagtagttttttagagggttataagttgttttataagttgaggggggtttttttgttttagagaattaatttttgtttttttggggataatagtatttattttaagaatgtatgaggtaaaagaaaatgtgttaggaaagatttgttttattttttttaagtggggtaagtttgtgatggtttaagatttttggatggggtgagggttgaggtgttgtgggtatggaggtaatataggagttagatttattgtttatttttttggtgtttttaaagtttttatttttttttttttaagattaaagatatttaaataagttttgtttttatagggttagttttggtttatgtatattttaattagttggaaatagtagtgttttagaatttgggataaattgattaaaatagaataggaggaagttaatttttgttgttaaatttgattttgagtgattgttttttgttttttgttttaggattattagtatagtatttttatgttttttatttaggattgtttttttatttaaagtgaagttttttttgttttttttttttattttttgattttagtagtaatatttgttaattagagaatattttaaaaatgaagagttttttgtttttagagatttttgtggttaatattgtaaaatatttaatttttgagatattttggttttattataaatattgttttgtgattgtttttttgtttagtattgtggtttgttttttgatttgtagagggaagagagggaggggtattttgaagtaattagtaagatttgtaagtaaaagggaagaagattaggttttaaaaggagtgttgtatttgtgtaggagggagatattgattttagttattagtgttttagagttggtattagttagttggtgttattaaaggaggaattaggattgttgttttgaaggaggtggtggaggatttaagggtagaggttttttattgttattatttggtgttattagtttagagtattttaagttattatttaatgtagagttttgtagagttagaagttttgggaggaatgggtatgtatggttttgtttattaagggtatatagattagtggtaggattgggttagaaatatgtaggatttgtatgattgagttgtaattggagtgttttatatattgtatttttatagtttttattagtaatggttgtgtttggatgttatttagtatgtttttatagtttattttttttttagaagttaatttggatttttttttttgtttgtattttttttttgttgatatggaatggggagatgttgttattttgtgttggtatttttaagtttagtgaatggttttttattatagtttaagttggttgttttattttttataaggtaaattagttttttttagggaagggttgtatattgagattattaatatagaatgtggttgtggatttttgtatatttttattgtagaggtgattttttttttttagtatttttgattagttttttagtatatatgtttttagtgaatggtatatatttaaggaatgattagtagtttttttgtgattttttgtagttattgttgttttttatttttttagaaaaattttttataattttttttttattttgtgttaatgtaagtttgattattttagtttgtgtttttttggttttaaagaattgaaaaattattttaattttaagtaggaaaaaaaaaagtgtgtttggggtggggattgattgatttttttaaataatagttgttgatattaggtgtttgagatttagggttgtaaatgttgttattaggatttggtttttttttatttttttgtagtagttttaggttgatatttttttagtttagtgattttagtagaattggggttggatttaggggttttaatttaagtgtaaagattgagttttatggtttggattgagttatgtttttgtttttgtattagttgtatggtaggtagtgtgtggttaggttgagtttgtggagtgtgtttttagtagttttttagagaaaaattaattaaggtgttattaagtttggagaaagtttagtgtgttttgggtagttttttgtttgggttttagttgtttttttttgggtagggatgttttttgttttttttgttgttattagtggtggttgtgtttggatattatttagggtttgtggtaaggtattttttttggaaattgagattttttgtttttttaattgtgtagagtggggaaggttgtaagagtagtttttgaggttttttagttaaataagaggttgttaggttttttgagggttgtttttttttaatttatatttttgatgagtatttttattttgttttgttgttttttttgaggtggagagtgagttttatgttaataggttttggtaatgggtttgtttaattgggttttttttttttttaaagtttgttgaaaatagttgatgttaaaatatagatgtttgtagttgttatggttttggggggtttttttttttatttgtttttattttagttttttaaaggaatgtgttttgtttatttaatagtttgttgtatatgtttattgtttagttttgtgattatagtaggatagtgaaagttgggggatatgtgtttatgtagtttatttgggtgttagtgaagtgtgatgttatgtaggtattttttttttttttttagtagttaggttttttatagttgttttggttatttagatggttaggtggtttggttatggatatttatttagttattttgttaggttagttattaattatttggtgattttttatgatttatatttttttttgtttttttttaatttatttttttttgttgatatttttgaggggttattttttgtgtttttattttttgaagtagatttttatatagtgagaattgatatatgggtttttgaataaatattagtgatgtgtttaattttatgataattttttagaattgtttgaaaataagtgattgttggtattagaagttatgtatgaaaaaagagtgtaaggggtaggtatttattggttgaattggggagttatatgggaattggggtttataggatatttatttttgaaatattttgagatatttgaaggaaatggttttttttattattttagtatttagagtgtggggaaatgtttttaatatagtggtttgtaaattagtggatgtgaagaagtaagaaaatgagatggttttagtatattttttaaaagtgattttatttatatttaagtggttgttagatttttttatagggtaatgttgtgtggttttttatttttattttttgtgtttgaggttgatagtttagaatgttgttgaggaagtgtatgtggtttgtttttgttgaataaagtggtaggttggttagtagggattggtggttgttattgttttttttttttgttgtgtagattttgtattttgtggggtttatgttttttttttttttagt

SEQ ID NO: 736 - DNA, 9353 bp, Artificial Sequence
  chemically treated genomic DNA (Homo sapiens)
attgaaaggagaaagaatgtgagttttgtagaatgtagagtttgtatagtaaggaggaggggtagtggtagttattgatttttgttgattagtttgttattttgtttagtaaagatagattatgtgtatttttttagtagtattttggattattagttttagatgtgggggatggaagtgaaaggttatatagtattgttttgtaggagaatttgatagttatttaagtgtaggtgagattatttttaaaagatatgttgaagttattttatttttttgtttttttatatttattgatttgtaaattattgtattaaaaatatttttttatattttgaatgttgagatagtaagggaaattattttttttaaatattttaaaatattttaaaaatagatgttttatggattttaatttttatgtggttttttagtttagttagtgaatgtttgttttttatgttttttttttatgtatggtttttgatattggtagttgtttgtttttaagtggttttgggagattattatgaagttaagtatattattgatgtttatttaaaggtttatgtgttaatttttattgtatgaggatttgttttaaggggtggagatatgggagatggttttttagaggtattagtagagagaaataagttaaagggaaatgagggggaatgtggattatggaagattattaaatggttagtggttgatttggtaaaatgattgaatgggtgtttatggttaagttatttgattatttgagtaattagaatagttgtggggagtttggttattgaagaggaggaggaagtgtttatatggtattgtgttttattggtatttaggtaggttgtatggatatgtattttttaatttttattattttgttatgattatagagttgagtaataaatatgtgtagtgggttgttgaatgaatagagtatatttttttggagagttggggtagaaataaatgaaaagaaaaattttttagggttatagtagttgtagatatttgtgttttgatattagttatttttaataggttttggggaagaaaggggtttagttgaataagtttgttattagagtttgttagtatggagtttattttttattttagagggagtagtgaggtagggtggggatgtttattgaaggtgtgggttaagaggggatgatttttagaggatttggtgattttttatttgattggaggattttagaagttgtttttgtagttttttttattttgtatggttgaaggaatagagaattttaatttttagaaagaatgttttattataggttttgagtggtgtttgggtataattattattgatgatagtagggagagtagaggatatttttatttaagaaagaataattggggtttaggtaggaaattgtttaggatatattgaattttttttaggtttgatggtgttttgattgatttttttttgaggagttgttgagggtatattttgtaggtttagtttagttatgtattgtttgttatgtaattggtgtggggataggaatatgatttaatttaggttataagatttaatttttgtatttgaattggaatttttgagtttagttttggttttgttggggttattgagttgggagaatgttagtttggagttgttgtaggaaagtggagggaggttaaattttggtgataatatttataattttgaattttaaatatttaatgttagtggttgttgtttggggaagttaattaatttttattttaaatatattttttttttttttgtttaagattaaagtggttttttagttttttggaattaaaagagtatagattaggataattaagtttgtgttggtatgaaatgaaaaaaaagttgtgagaggtttttttagaaaagtaaaagatagtaatgattgtaagaggttatgaagaagttgttgattattttttggatatgtgttatttgttggagatatgtgtgttgggaggttgattaaaggtgttggagggaaaaagttatttttgtaatgaaaatgtatgaggatttataattatattttatgttaatgattttaatgtatagtttttttttgagagaaattaatttgttttatgaaaaatgaagtagttaatttaagttatggtgagaaattatttattaaatttgggaatgttaatataggatgataatatttttttattttatgttaataaagagaaaatgtaaatagaaggaggggtttagattgatttttaaaaagaaggtaaattatgaaaatatgttgggtggtatttaggtatagttattattgatgagagttgtagaaatgtagtatatgaaatattttaattatagtttaattatataaattttatatgtttttaatttgattttgttattaatttgtgtgtttttgatgggtaaaattatgtatgtttattttttttagaatttttggttttgtaaagttttatgttgggtagtgatttgaaatgttttgggttgatggtattaagtgatggtagtgagaagtttttgtttttgagttttttattattttttttaagatagtggttttagttttttttttgataatattggttggttaatattaattttgagatattgataattaaaattagtgttttttttttatatagatataatattttttttaaaatttagttttttttttttttgtttataggttttgttagttattttaagatattttttttttttttttttttgtaagttaaaaagtaagttatagtgttaaataggaagatggttataggatagtgtttatggtaaaattaaagtattttagagattggatattttgtaatattaattatggggatttttgggaatagggaattttttatttttgaaatgttttttagttagtaggtgttattattgaaattaaaggataaggggagggggtaaaggaaattttattttgggtaaagaaatggttttgagtaggaagtatgagaatgttgtgttgataattttggagtaaggaataggaaatgattatttagaattaggtttggtagtagaaattaatttttttttgttttgttttaattaatttgttttaaattttaagatattgttgtttttaattagttgagatgtgtatggattaggattgattttgtaggggtagggtttatttaaatgtttttggttttgaagaggaagagatgggggttttagagatattagggaagtgaatagtaaatttggtttttgtgttatttttatgtttatagtgttttaatttttattttatttaaggattttgggttattataagtttattttatttggggaaggtggagtaagttttttttggtatatttttttttattttatgtatttttaaagtgggtgttattgtttttaaagagataaaaattagttttttggggtaaaaaaattttttttagtttatagaatagtttgtgattttttagaaggttattggttataagtagaagtataatattatttttgatattataattttattttggggtaaattaggggaaaaaaaagttttataaggtttttaggtgggagggaggtagtgattatggtaaaagatggagaaatatagttgtatttttagttttaggagtattttgtgagtatatataggagatttataatgatttttatttttaataattttttaattagattaaaaatattattagtaataagatattggtgggtattagatattatttttgttttaaaagttttttggttttataatgttgtgatgggtttttgttgttgttgttgtttttgagattgagtttttttttgtttttgttgtttaggttggagtgtagtggtataattttagattatggtaatttttattttttggatttaagtgatttttttgttttagttttttaagtagttgggattataggtatttattattatgttgggttaatttttgtatttttaagtagagagggggttttattatgttggttagttggttttgaatttttgattttaggtgatttatttgttttggttttttaaagtgttgggattataggtgtaattgtttattatttaatgtagaaggtaagattgttagaaagaaattttgtttaagttatatgggtttggggtagagatggtttttttatttgtttgaaatttttatttgagaagagaatggagtttgaggatttttaagagtagagattattagagttttgttgagggtttgaaaggtataatatagttgttatggtatgggaagatttaggagaataaggaattgtatttgtttgtagggttttttttagttgttataaagataggtaaaggattatattttttgttgagtatttgtgaaagaatatatatatatatataagggaaaggtttttttgtttggttgtttttttagatggagttttgttttattgtttaggttggagtgtagtggtgggattttggtttattgtaatttttatatttggggtttaagtgatttttttgttttagttttttaagtagttgggattataggtgtgtgttatgatgttgggttaattttttgtatttttagtagagatggggttttattatgttagttaggatggtttttattttttgattttatgatttgtttgtttttgttttttaaagtgttggggttataggtgtgagttattgtgtttggttttagggaaaggttttaagttattaaaaaaaaaaaggaagttgattttaagtttatttttatattattattttgatttattattttttgttgtttttattgtataattttatattaatttgatttttttatttataggaatataagtgggtgtttttattatatagttatttttaaagttgttttatttttttatatgaatttaatatataatttttggatatttatttttatatttgttaggtattgtgagaagtgttagaaatagtaatgaatgaagtagatatttaattttttaatgaattttgtttattggaatgtataatttaaatgtatagatgttatgatgtgatgttattttaaataaatatatagttttttggggtattgagtgtttaagtgaataatttgaaatttttttttataaatttttattttttagtttggataatatagggaaatttgtttttataaaaaattaaaaataaattatttgagtgtggtggtatatatttgtggttttagttatttgggaggttgaggtatgaggattatttgagtttaagaggttaaggttatagtgaattatgattatgttattgtattttagtttgggtgatattgagtttttgttttaaaaaaaaaaaaataaatttttattttttatttattttagagtagtgatttttaaatgatgggttataaaattagtttttggaggtatgataataatttttggaaaaatggaatagaaaaaaatattgaaatgtagtttatataggttaagtattgttaagtaatttttattttagttatatgtatatatttgtgtgttgtattatgtttagaaagtatttgttattgttaagaaagtatttttttgtatttattttaagagtataatatgtaatagatggaaattagtttggtgttatggttgtaatttaattataattttagagatattattggagtttttggaggaaataaattatgtattttgattattttggttaagaaatattttttttgatgtaaatgattttttttttattttatatttattaatttttaatagtaggttttagggtatatgtaaatttttttgttttattttaaatattttatagtttatttagttttttttgttgttttttttttttgtttgtgtgtaaatatttaatgtttaggtttatatttaaattttaagagaaaaatttgggatgtgggtttgttagatggtttatatttgtagttttgggaggtgaggtgggaggagtgttttgagtttaggaattggagattattttaagtaataagtggagattgtttttgtggggaagaaaaaagattagttaggtgtggtggtgagtgtttgtagttttagttatttgtagtgttgaggtaggaggattatttgagtttaggagttttaggttgtaatgaattatgattgtgttattgtattttagtttgggtaatgagattttgttataaataaataagtaaataataaaaatagaaattgagaaatttaggttatggttgtggaatataatatgtaatatttagaaggttaaaaattttaggttttgttttagtttttatattattatttttgttgtttaatttttagataattaggtttaggttattatttttggttttttatattatattattattttttatattttatgatgttttatgttttattgttatttttatttggttaggtattttttggggatgttgtgtggtgttgaggttttatagggaaaatgttaattttggtgttttttgaattattaattagttatggggtgtttagattttttttttgagttttagatttagggtattttgaggtggtgtttggttgaggagttttgtattgtgttttgttaatagttgggtttgggtaaatttgtgttatttaattttttgttttttattggtttgagatgtttattttttagggagggtaagaattgaaatgattgagattaattatttataagtgaggtaattgggttataggtgttttgagggaaaggaggttgggtttgtgtttttatattttgttgatggttttatgtttttgtttgtgtttgaggtttattggtttgtgaagtttattttttttgttttttttttgtgttgtgttgtttggggtgtttgttaggatttaaaatgtggattggtgggttgtttattaagggttgtttgtggtagggtgggggtttttgtgagttgtttttaaattttatttgtaggatgttgttttgatgtttagggttaatttggggagttaaggtttttggtttttgtaaggttgattttagtttgttggggattttgtaagtttgtgtgtggtttttagtatgttgggtgtttgtggggtgagttgtttagggttatttggggttttttgttaatataggttgtgtggagagtgtgaggtgagttttgggtttgtgtttttatgagtatttattttttaggtatttaattttaggatgggtattttggtgttgttgttgagtaggagatggtttgttatggttgttgtgttttttagatttttgtttagtatggtgtggttttggttttggtgtgtatttttaaatagtttgtgaggttggtagaaagggtgtttgtggttggtgtgttgttgtgtgaaggagttttttgattggttgtgttgggggtgttgtggtggttttttttaagggttggtggggatgttttttttgtttggttttagtggtagtggattttttttgtttttaatgtttgtttgtgttttgtgtggtagaaaggagttttttagttgttgtatttggtgggaaagtgaatgttttagtgaaaataataggtattttataaatatatagattagaaataagttttggttttattaagagtttagaagaatgtttttgttgtttaattttagtttgatgttttttgggaatttgatgaatattttgtttttaatttatgtgaattatattgattatatatatagtttattgtattttgtttttagataaaggtgtatgttagaaaaatggtttgtaatttttttgtaaagtatttttataaaatatgggtttgtttagattttttgtagttttttagatttttttttgtattttattttaggtgttagttgtgtttgtgtatattaggtgtggtttagtaagttttttattaaaagttagtattttttgatgtttttgaggttagaaagttttgatgggtttgatttagaatttttagaagaatttggaaagtaaggttgtttatttagaattagtaagataaattttattagttttgggaaagtgagattttattaaagtagtaagttttagtatagtaatttattaaaattttttagaggaagaaaagtgaatagatagaaaattatagaagaaaaagttgattttaatattgtagtttttagtattttaaattagaaggtataaaatagtaaattgattattttaattggtaggtagaaatatatatttttttaagatagtttaagaaaagttatttgaagatttttgaagataattttggtttttttttaataatttttttttatgatattttattttattttaattgttttttttgttttattattttttgattttttttttaattatgtaagattgggaattttatttgtttggtagtgatttaagtattaggtttttttaaattttatgttggtgattttttatttggtgttttttttaaaagtgtttttttttggaaaaatttatatagaatagattagtttagatatttttttatgtaatttttgtaaaaattgttgttattgggtaaatttatttgtttttaagtaatagaatttgaatttgagtttaaagttgggaatttgttttgtgtaaaatagtaagtttttttttttatgagagtttttttgatttggaggttgttttgttaattgaattttttgggtttaaatttaaagagttaattttttgtgaaaatgatatattttgagtggttaggttggtatatatagaagggttgtttgttagggatatggatttaatattagaggttttgttgttggtttgataataattgagtatatagtttgattgtatgaagttataattgtgtttaaagttggagtgatatttgtagttttagttttttaggaggttgaggtgggatgattgtttgagtttaggagttagagattagtttggataatatagtaagattttgtttgtaaaataaataaataaatttagaatattttggttgggttatgtagatatgaaaagttgtattagtggaatttttatagtaataatagtattttagttgggatatgttattgtgatagttttttaatattttttattgtttttgtaatttttgtaaaatgtatatatattaaaatttttgattttaagatttttgattttttgttttttgataagtatatatattaaaattttgtttgaaaaagggaaaaaaatttttaatggaatttttttgagaaatattttagtaattggaattttaatatgttttgaattagtaattttttattat

SEQ ID NO: 737 - DNA, 10865 bp, Artificial Sequence
  chemically treated genomic DNA (Homo sapiens)
ggtaattgtttatttttgggtttttggtttggaagagattgttggtattattatttagtttttttattttttaggtaaggagttaatgaagataatatttttagtgatatatggtaagttattgtggtgttggggttttagtgttaggagttttttttttttttttggtatttttgttattatgttaggttggttttttttagtagatataatattattgaaaaatattataagtgtttttgtggagagtagagtagatagttattaaaattataaaagtttatgttttttggtttaatatttttattttaaggtatttaattttttttatagatatatttatgtgagggtaaaatgatttttgtataattttattttttgtaatattgattgtaataaggaaatattggaagtaatttagatgtttatgggtgggaggtgagttatataaattagggattatttatataaatagaatatgtgtagttgtgaaaagattgggttatttttttatgtgtaataggaatagttttattttgttaggtgtggtggtttatatttgtaattttagtattttgggaggtgaaggtggggtggattttttgagtttaggtattttagattagtttgggtaatgtagtgatatgtttttattgtgtaaataaaataaaataatatattatttgttttgtagatgttattgttgttaggagttttgtaatattagttattgttaattttattgtgttttttaatattattgttgatggtaagtttttagatttgtgttttttttaagttgtttgtagataaggttttaaagttagtagaaaatttttgtgttttgagtattggagagaaaggatttggttataagagtttttgtttttatagaattattttagggtttatgtgttagggtggtgattttatatgttataatggtattggtggtaagtttatttatggggagaaatttgatgatgagaattttattttaaagtatataggttttggtatgttgtttatggtaaatgttggatttaatataaatggtttttagtttttaatttgtattgttaagattgagtggttggatggtaagtttgtggtttttggtaaggtgaaggtatgaatattgtggaggttatggagtgttttgtgtttaggaatggtaagattggttagaagattattattgttgattgtggatagtttttataagtttgatttgtgttttattttaattattagattattttttttgtagtttaggggagtattttttattttatttgtttttagtattttagaatttttgtgtttttgttgtggttttttttgggttttatgttttttttgtttttttttatgtttagttggattgtagagttaagtttatgattatgaaataaaaattaaataataaaataataataatagtatattatttgttttttagtgtatataatatttttggaaagatttaaaagaaattggtagtaggatttaataaggtggatagggggtatttttttttattttgaattatgtggatgtattatatatttaaaatgtaaaataaaaaatttataagtattttttatttttttaatttgaagaaaagagaagaagaagaaaattttaaagttagtaaaggttagtttgggtttttagatttaagtttgatagtaattagaatgttaggttatatgtggtgtaggttatagggttttggtttttggttatttattgttaggtttatataatagataaggaggtgttattgtttgttgtttgttttttttatattagtttattttggtttttgattttttgggtttgatatggaagattttgggattttattatttttaattaatattgtttttttaaattttgttttttggtagttatagtaaggttatatttagtttaggattatataaaaagggttgtttttttttttgaggattgattgtgtggaagtattaggtattagagatagagttttttttggtattgtaggagagaatttgaagggatgatggatgtattaaaaggtgagtgggtgaaatttttatggagttttatatgtttttttagttagttggttttaaattgtttttttgtttttgttgggtgtttggggttattgtttttttattttgatttgtggttttggtgttgtttgttttttgttttatttttttttagaaaatttataaattttttatttaggtataattttagatttataaaaagattgtaagaataaaaagaagaatttttatatattttttatttagattttttaaattattattgtatttgttttattttttttgattagtggatagatagatgatatagatagatagatagataaatatatattttttgaatttttgagagtaagttgtagatattatattattaaatattttggtgtgtattttttaaagataaggatatttttttatgtaattaatataattatgaagattaggatatgaatattattttaatattgttatttaatttatagattttatgtagattttattaattgttttaataatgttatttatagtagaagaaaattttgggttaggttttgtattttgttgttgtgtttttttggttttttttgtttggaatagtttttttgttatttttggagttttgtgattttaatatttttgaagagtatagattagttattttgtagaatgttttttaatgtgttttgtttttttttaaggttatttgatggatttttttattgtagagggtttgtttgttgttgttagtagtgttattgttttttagagtggggaatagtagagtggagttatgtgttaggttttgtgttttatgaggatgtagttgtttattattattaagagtagatattagagtttttagttttattttagggagtttgggtgttgttagggaataatgaggttgggtttgaatttttttgttgattttttagtttataagttttttgtaattttttagtagggtttgtttagtagtttttttttttgtttgagaagttgtttgataagttaaggaatggttgttttgaaattttgtaaagggattaagttagatttttttagtttttatttttttttttggagggtgatattgtgaaataaattagatttttttttttagttttaaggttatagagttttgaatttttttttagatggttgatgttttagttagatttagttttggagggtatagagtttttaggattgagaaagggtggtgtggtgtgatgggaagtatttgttgatttgagagaagatttatgtttaaatagttttgtggttttgggtaggttatattaattttgtgaaagtattatataaattattgaggattatttgaaggaaaggtagttttgatttatattgttatttttaagaggtgtgatttgtttattggggaggtttgatgatttgattgaggttttagttatgggtggtagagttgggatataaatttggtgtgtgtttattttatgttatattatgttgtttttttgttgggtataatttgattttatttttaaggtttaaattattaaagatagttattttttggttattagtgttggggtgttggtgaggggagttgatgttttttgaggtgttttttttgatgggtttgtgtaagtaattattatatgttattttataatattagtaagttgtgatgattttatggtgtttttatgaatatgattttatttgtttttttaattattttaggaggttaggatatttaaatagggatttggaagatggtgatatgtgtgggataaaggtaggattttatataaatggaggaaatgagaaattgtgtattttatggtattaggataattggttagtatttagagaaaaataaagttagatatttattttatggtttattttataatgaattttagaaaggttgaagatgaaattgtaaaggtaatagaagaaaatgaaggtaatatgaaaaataattttagagtagagaaggtgttataaaggaaaatagaaaatttagaaatataaaggaaaagaatagtaaaattgattttagaaaaattaaaaatatgtgtaagataaaatttttagagttagaaggtaatggaattgtgaagggtatttttaatatatatgagaagtaaatgttgttttgtagtataaaaagagtttttagatttataagaaaatgattaatattttaaaatatatatggataaagagtagtattaggtagtttaaagaaaaagaaatataaattgtaatatatgaaaagatgtttaattttatttgtaatgagggtggttatgaaataaaattgaaatagtaggttaggtatggtggtttatgtttataatttttaaaatttgggaggttgaggtaggaggattgtttgagtttaggagtttgagattagtttggaaaatatagtgagattttgtttttataaaataatttaaaaattagttgtggtttagtaaggtggtttatgtttgtaattttagtattttgggaagttaaggtgggtagattatttgagattagaagttagggataagtttggttattatggtgaaattttgtttttattaaaaaatataaaaattagttgggtgtggtggggtatattggtaattttagttatttgggtgattgaggtatgagaattgtttgaatttgggaggtggaggttgtagtgagttgagattgtattttagtttgggtaatagagtgagattttgttttaaaaataaataaataaataaaaataaaaattagttagatatggtggtgtatattggtagttttagttatttagttatttaggtttaaggttgtagtgagttatgattgtaatattgtattttagtttgggtgataggttaagattttgttttttaaaaaaaaaaaaggttatataaaagtaaaatagtaatgagattttatttttttatttattagattagttaagattaaaagtttaatagtaaatagttttaaaaaggtatttttttatttttttgtaggagtattattggtgtagttgttagaaggttttttggtaatatttgttgaaattaaagatgtttatattttgtgatatagtaattttgttttggaagattttttttataaatattgttatatatgagtgtaaagatatatgtataaggaagtatattgtagtatataagattttaaatggtttatatgtttatttagggggataatagttattaaaaagtaataaggttgagattagtttgggtaatataaggagattttttttttataaaaaatgaaaaaattagttgggtgtggtgatgtatgtttgtagtgttagttatttaggaggatgaggtgagaggattgttttagtttaggaggttgaggttgtagtgagttgtgattatattattgtattttagtttgggaaatagaatgagattttgttttaaaaaaagaaaaaaaaattaaaagaaaataataataagatttatttgggtggttaggagataaattttaagatatgtgtgtgagagagagagggagaaaaagagagagagagagagaagtaaggtgtagaatagtgtattgagaaagtttttgtttttgtaattaaagtaatggtttatggtagagaaaattggaaagatatttagatattttatagtgattttttttggagaaaggatttgggagtttgggatgggagagaaatttaatttttgtaatgggtatttattatttttgttttattattattattattattattattattattattattattattattatttgagatgaggttttattttgttatttaggttggagtatagtgatgtgattttggtttattgtagtttttagtttttaggtttaagtgatttttttattttagttttttgaatagttgggattataggtatgtgttatattatttagttaattttttatttttagtagagatggggttttattatgttggttaggttggttatgaatttttggttttaagtgatttgtttgttttggttttttaaaatgttgggattataggtgtgagttgttgtgtttggttttttttttattttatttgtgattttttgtggtttttaaataagaggatttatgttttttatttattttggaaagtttttaattattatttttttgttgttgttttttatttttgattttttttttttagaataattatagtatatagtttagttttttttatttaagattttgtgtttttaaattgttttttatatttatttttattaatatttttttaggttgtattataggtatttgtttttagtttattttttagtttattgatttttttttagttatgtttatttgttgtttaatttgtgagttttttttattttgagaattatatttttatttttagaagttatgttttaaaaaatttatttggttatttttaatagtggtttattttttttttattattttgatttatttttttaggtttttagttatttttgatttggttattttatggtttttttttttttttttttttttttttttatatatatatatatatatatagtttatttaatttaattaatttatttatttatttttgagatggagttttatttttattgtttaggttagagtgttatggtgtgattttggtttattgtaatttttgtttttttggtttaagtaatttttttgttttagttttttgagtagttgggattataggtatgtgttattaagtttggttaatttttttttttttttttgagatagagttttattttgttgtttaggttggagtgtagtggtgtaattttggtttattgtaagttttgttttttaggtttatgttatttttttgatttagttttttaagtagttgggattataggtgtttgttattatatttggttaattttgattttgtatttttagtagagatggggttttattgtgttggttaggttggttttgaatttttgattttaggtgatttgtttatttttgttttttaaagtgttgggattataggtatgagttattgtgtttggttttatattttttaatattttattttatttattattttttgaaataaggttttattttgttatttaggttgtagtgtagtggtgtgaatatggtttattgtagttttgattttttaggtttaagagatatttttgttttagttttttaagtagttgagattgtatgtgtatattattatttttagttaattaaataatttttttttaaagatagggtttttttatgttgtttaggttgattttgaatttttgggtttaagggatttttttgttttagttttttaaagtgttgggattataggtgtgagttattgtgtttggtttatagtttatatatgttattttatagtttgtatattatttgattttttggatgaatatttgtgtggtttttgttgaaatagtgtattttgtgttttaaaatttggggttataagtttattttgagtgtgattttatttgtgggaatgttataaaattttggtggagaatgaattattttaaagaagattggtgtttattttttaaattagtgataattgtgattaggagttagtttttgtttatgagttaaggataattgtttattttatttttttagtatgggggaattttagatttttatagaaagaggtgatgtttgaaattttttataattggtatgtattttgtaggggttgtgtttttataagtattttgggaaggagattttttaggagtgtttgttggtaggtggtagtagatttaggtagtaatatggatattggggggtgggggaatgtgattttttgtggtaaaaagtataaagaaaaattagtaaagggaaaagtttgttggggtgaggttttgagggagttaggtaggttttttaagagttttttttagtgttatataggatgtgtttaatttttttagtaattagttgtgatatgttttttttttgtgtattttatttatttagtaattataattttattttttttttgtttttagtaattttttatttttatttagattttttatttggaatggttgtttgtaagagggataaaagtatttttatagaaaaatattttaatataatttaattagaataatatattatattttggaattggttaggataaaattttgaatttttaaaaatttttaaaatggtagtttgggtgtggtggtttgtgtttgtaattttaatatttttggaggttgaggtaggaggattgtttgaatttaggagtttgagattagtttgggtaatatagtaagattttattattattatgaagtgtattatggtgtatatttgtagttttagttattttggaggttgaagtgggaggattttttgagtttaggaggttgtggttgtagtgagttgtgtttatattatggtattttagtttgggtgatagagtaaggttttgtattaaaaaaaaaaaaattaaagtaattttaaataattttttattattttttgttttgattatttatttattgagtagtttagaaaaggttagtttttttttggggaaagttgtatttaataattaaattgttttattagaaggaaggagaaggaaattgtattagtttattttttgttgtttataaaagaatatttaaaatttaggtaatttataaagaaaagaaatttatttattatagttatggaggttgagattttaaggttgaggagttgtatttggtgagggttttttttttagtgaggattttttgaggagttttaaggtggtgttgggtattatatggtaagtttaggtttttttttttttataaagttattaagatttttttaagtgtgtttttttttgttattttaagagttttatttgatttatttaaaaatatatatatagattggaaaattataagtttttaaggttgataattttataagagtttattagtaattaatgtttataatagtggtataaatgggttaagatgttttagttagttattggtttattttaaggtttagtttaagaaggggaagtatttgggaaggtaggtttgtttgttaggtgggtttttttgttggaggtagtaggtttttaggttttgtgtgtagtgtgaagggaaggttatttgttgggatttgtttttttggagaatatttgtttagattttaattttaaagttattttagtaagaatgagttgtgttgtttttaaatatattattggttgtatttttaaggtaggtatttgatgtgggtgtgattattttatttattttgtagttatgaaagtttagtttttatggttggtttttttgatttttgtagaggatgggttttttttgtgggtgagtttttaggagtagaggaaggtttttgtattttattttattttattttataggttatagtggggttttttaatttaggggttttttatatgtgtttttttgggttagtagtatagtgttattaaggaagttgttggagaggtaaatttttagttatattttagatgtgttgaattagaaatttagggtgggtttggtagtttgtgttttattatgttttttgtatatttgaattgtttggaaagttttgaaaatatagaggtttagttttatttagaataattgtattagaattgttgggggagaatataagtagttttataatttttaggtggttttagtatgtagttaaaatatatttttttttatgatttatgagtttgggaatggtttgaattttagataaaggggaggggtttgggttttaagttgaggtaatatgaaatgttattataatagatatatggtgagaaatatatgtgttatagaaaagggtgtattatgtatgtggagattattttttttattgaatgtattttttattttagtattgaagaaaaaaattttttgttttttttgggggggatggagttttattttgttatttattttggagtgtagtggtttgattttggtttttgattttaggtgatgtgttgtttttatagttttttaaagtgttgggattagaggtgtgaattattgtatttggttttaaaaattttatttataatgtaagtagttttggttttagattatgggagttttttggtgttttttttttaatttggataaaaaggttttattttagttattttgtattttatttttttttttaggatgtgaatttttattttaggatggtgtttgatttgaagttgatgggagtttgggttgaataggaaggggagtaattttagggtttatttgttttttttttagtttgtttgtttttttttttttttttagtttttgtgttgattgatggagaatattttggtattaggtttgtttttgaggttatgtttgtagagagggggagttggggtgggaaatttgtttaatagttatttatagatttattttgtttgaaatttagtttttttatttgtaagatgggtgtgtatttatttattttgtggggttatatgattaagtatttgagtttattgtttttagtttatttttatgtaattttataaggtaggtatgtgtatattagttttataggtgaagaaattgagttttagatagatttataattagttggaggtggagtagggatgtttgattttaaagtttagttttattttaatgtatttttagattttgaatttagaaagaggtgattagggaataaatattttttgtgttttttttttatatgtgttgt

SEQ ID NO: 738 - DNA, 10865 bp, Artificial Sequence
  chemically treated genomic DNA (Homo sapiens)
gtagtatatgtggaaagagagtatagagaatgtttattttttgattatttttttttgggtttaaaatttgagagtgtattgaggtggagttgggttttagagttgggtatttttgttttatttttagttggttatgaatttgtttgagatttagtttttttatttgtaagattggtgtgtatatatttattttgtgggattatatggggatgagttgagagtagtggatttaagtgtttagttatgtaattttgtaaaataggtaagtgtatgtttattttataggtgaggaaattgagttttaaatagggtgagtttgtgagtggttgttaggtaagttttttattttaattttttttttttgtagatatggttttaggaataaatttggtgttagggtgttttttgttaattaatataaaagttgaagggaaagaggggagtgggtaaattgaggagggaatagatgagttttgggattgtttttttttttgtttagtttagatttttattagttttaagttagatattattttgaggtgagagtttatattttgaagagaagggtggggtgtaaagtggttggggtgaagtttttttatttaaattgaggaggaagtattaaggagtttttatgatttgaggttaagattatttgtattataaatgggatttttaaggttaggtgtagtggtttatgtttttaattttagtattttgggaggttgtgggggtggtgtattatttgagattaggagttgagattaagttattgtattttagaatgggtgatagagtgagattttattttttttaaaaaaaataggggatttttttttttaatgttaaagtgaaaagtatatttagtaaaagaaataatttttatatgtataatatatttttttttgtagtatatgtattttttattatgtgtttgttataatgatattttgtattattttagtttgagatttaaattttttttttttatttaaaatttaaattatttttaggtttatgagttatgaagggaaatgtgttttggttgtatgttgaaattatttgggggttgtaaaattatttatgtttttttttagtgattttgatataattgttttgagtggggttgagtttttatgtttttaaagttttttaggtaatttgagtgtgtagagggtatggtaaaatatagattgttagatttattttgagtttttgatttagtatatttggggtgtggttgagaatttgtttttttagtagtttttttgatgatgttgtgttgttggtttagggaggtatatatggagaatttttagattaggaagttttgttgtggtttgtgaggtaaagtgaggtgagatgtagggatttttttttgtttttgagggtttatttatagaggaaatttattttttgtagagattaaggaggttagttatggaaattgggtttttatgattataaaataggtggagtggttatgtttatattagatgtttattttggggatgtggttagtgatgtgtttggagatagtatagtttatttttgttggagtggttttgggattggggtttggataagtgttttttaggaaggtaagttttagtaagtggttttttttttatattgtgtatagggtttgggaatttgttgtttttagtagggaggtttatttggtagatagatttatttttttaggtgttttttttttttgggttgaattttggggtgggttgatggttagttggagtattttagtttatttgtgttattgttatgggtattagttgttaatgagtttttgtgaaattgttagttttagaagtttatgattttttagtttgtatgtatatttttgagtgggttaagtgggatttttgaaatgataagaaaaaatgtatttaagaggattttggtgattttataagaagaggaagatttgagtttattatgtgatgtttagtattattttgggattttttagggagtttttgttaggaagaaggtttttattagatgtagttttttgattttggagttttagtttttataattgtaataaatgaattttttttttttataaattatttgagttttaggtatttttttataagtaatagaaaataaattaatataatttttttttttttttttttggtaaggtagtttgattattaaatatagttttttttagaaagggattgattttttttaggttgtttaatgaataaatgattaggataaaaaatagtgagaggttatttaagattattttgatttttttttttttaatatagggttttgttttgttatttaggttggagtgttgtggtgtgaatatggtttattgtagttataattttttgagtttaagggatttttttattttagtttttagagtagttgggattataggtgtgtattatagtgtattttatagtggtgatgaagttttattatgttgtttaggttggttttaaatttttgaatttaagtgatttttttgttttagtttttaaaaatgttggaattatagatatgagttattatatttgaattattattttgaaaatttttgaaaatttaggattttgttttgattaattttagaatatgatgtgttattttggttaggttgtattaaaatatttttttgtaaaaatgtttttgttttttttgtaaataattattttagatgaaaggtttgggtgagaataagagattattaaaaataaaaagaaaataaagttatgattgttgaatgaatgagatatatagagaaaaaatatgttataattaattgttaaaggaattaaatatattttgtgtgatattggagaggatttttggaagatttgtttagtttttttaggattttattttagtaggtttttttttttgttgatttttttttgtattttttgttataagaaattatatttttttattttttagtgtttatattgttgtttgagtttattgttatttgttagtaggtatttttggagagttttttttttagagtgtttgtgggagtatagtttttgtagaatgtatattggttatgaaaaattttaaatattatttttttttgtagaggtttgggatttttttatattgagaaagtaaaataaatagttgtttttggtttataggtagaaattggtttttagttatagttgttattggtttaggggataaatgttaattttttttggagtaatttattttttattaaagttttatggtatttttatagataaagttatatttaaggtgagtttatagttttaaattttaaaatataaaatatattattttagtagaaattatataagtatttgtttaagaaattagataatatatagattataaaataatgtatatagattatggattaggtatagtggtttatgtttatgattttaatattttgggaggttgaggtagggggattttttgagtttaggagtttaagattagtttgggtaatatagagaaattttgtttttaaaaaaaaattatttaattaattgagaatggtgatgtgtatatgtagttttagttatttgggaggttgaggtaagagtattttttgggtttgggaggttaaggttgtagtgagttatgtttatattattatattatagtttgggtgatagggtgagattttattttaaaaaataataaataaaataaaatattaaaaaatatagggttgggtatagtggtttatgtttgtaattttagtattttgggaggtagaagtgggtagattatttgaggttaggagtttgagattagtttgattaatatggtgaaattttgtttttattaaaaatataaaattaaaattagttggatgtggtggtaggtgtttgtagttttagttatttgggaggttgagttgggagaatggtgtgaatttgggaggtagagtttgtagtgagttgagattgtgttattgtattttagtttgggtgatagagtgagattttgttttaaaaaaaaaaaaaaaaattagttaggtttggtggtatatgtttgtaattttagttatttgagaggttgaggtagaagaattgtttgaattggggaggtagaggttgtagtgagttgagattatgttatggtattttagtttgggtaataagagtgaaattttattttaaaaataaataaataaattaattaaattaaataaattatatatatatatatatatatagagagagagagagagagagagagagagattataaaatagttaagttaaaaatggttagggatttaagagaataaattagaatgatgagaaaggaataagttattattaagaatgattagataaattttttaaaatataatttttaaaaatgaaaatatggtttttaaaatgaaaaaaatttataggttaaatagtaaatagatataattgaaagagaattagtgaattagaaaatagattggaaataaatatttataatataatttagagaaatattaatagaagtaaatatgaaaagtagtttagagatgtggagttttggatgaaaagggttaaattatatattatagttgttttgaaaggagagaattaagaatggggagtagtagtgaagaggtgatggttgaaaattttttaaaatgaatgagagatatgaatttttttatttaggaattataaagaattataaataggataaagaagaggttaggtgtagtggtttatgtttgtaattttagtattttgggaggttaggataggtggattatttgaggttaggagtttatgattagtttggttaatatggtgaaattttatttttattaaaaataaaaaattagttgggtaatgtggtgtatgtttgtaattttagttatttaggaggttgaggtaggagaattgtttgaatttgggaattggaggttgtagtgaattgagattatgttattgtgttttagtttgggtgatagagtgagattttattttaaataataataataataataataataataataataataataataataataaaataaaagtaataaatgtttattataaaaattaagttttttttttattttagatttttagattttttttttagagaaaattattataaagtatttaggtatttttttagttttttttgttataaattattattttagttatagaaataggagtttttttaatatattattttgtgttttgttttttttttttttttttttttttttttttttttttttatatatatgttttgaaatttattttttaattatttaagtagattttgttattatttttttttaatttttttttttttttttgagatagagttttattttgttttttaggttggagtgtaatggtgtgattatagtttattgtagttttgattttttgggttgaagtaatttttttattttatttttttgagtagttggtattataggtatgtattattatatttagttaatttttttattttttgtgaagaaggggtttttttatgttgtttaggttggttttaattttgttattttttagtagttattatttttttggatggatatgtagattatttaaaattttatatgttataatgtatttttttgtatatgtatttttgtatttatgtgtgataatatttgtaagagaaattttttaaagtagaattgttgtgttataggatatgggtatttttaattttagtaaatgttgttagagagttttttagtgattgtattagtgatatttttataaaaagatgagaagatgtttttttaaagttatttattattaaatttttaattttggttaatttgataaatgaaaaaatgaaattttattgttgttttgtttttatataattttttttttttttaagagatagagttttggtttgttatttaggttgaagtgtagtgttgtaattatggtttattgtagttttgaatttgagtagttgagtagttggaattattgatatgtattattatgtttggttaatttttatttttatttatttatttatttttgagataaagttttgttttgttgtttagattggagtgtagttttagtttattgtagtttttgttttttaggtttaagtaatttttatgttttagttatttaagtagttgggattattggtgtattttattatatttggttaatttttgtattttttagtagagatggggttttattatgatggttaggtttgtttttaatttttgattttaagtgatttgtttattttggttttttaaagtgttgggattataggtatgagttattttgttgggttatggttaatttttaaattgttttgtggagatagggttttattatgttttttaggttggttttgaatttttgggtttaagtaatttttttattttagttttttaaattttggggattataggtatgaattattatatttggtttgttgttttagttttattttatgattatttttgttataagtaaggttgagtatttttttatatattataatttatatttttttttttttgaattatttaatattgttttttgtttatgtatattttgggatgttggttatttttttatagatttgagagttttttttatattatagaatagtatttgttttttatatgtgttgaaagtattttttatagttttattattttttgattttggaggttttgttttatatatatttttaatttttttggagttagttttattgttttttttttttatgtttttaggttttttatttttttttgtaatattttttttattttaagattattttttatattgtttttatttttttttattgtttttatagttttgtttttgatttttttgggatttgttgtgggataagttatgagatagatatttggttttgtttttttttaaatattaattagttgttttaatattataaagtgtataattttttattttttttatttatatgaaattttatttttattttatatatattattattttttaggtttttatttggatgttttgattttttagagtggttggaagaataaatgaaattatatttatgaaaatattatggagttattataatttgttaatgttgtaaggtggtatgtgatggttatttgtataagtttattagaaaggatattttagggagtgttagttttttttattaatattttaatattggtggttaggagatgattgtttttggtgatttagattttgagagtaaagttaaattgtgtttagtagggaggtagtatagtgtggtatgaaatgaatatatgttgggtttgtgttttagttttgttatttatggttgggattttagttaagttattaaatttttttagtgaataggttatattttttgaaaatgatagtgtgggttaggattattttttttttaggtagtttttagtaatttatatagtgtttttatgggattgatgtaatttgtttaaagttatagggttatttagatatgaatttttttttaaattagtaggtgttttttattatattatattatttttttttagttttaaggattttgtattttttaagattgagtttagttgaggtgttagttatttaaggaggaatttaaaattttgtggttttgggattaaaaagaagagtttgatttattttgtaatgttattttttaaaaaagaaggtggaaattaggagggtttggtttagtttttttgtagagttttaaagtagttattttttggtttattaagtagttttttaagtaagagagaaggttgttgagtaaattttgttgggaggttatagagggtttgtgggttggggagttagtagaggggtttaaatttagttttgttgttttttagtagtatttggattttttgaagtaaaattgagggttttggtgtttgtttttggtggtggtaggtggttgtatttttatgggatatagagtttggtatatgattttgttttgttattttttattttgagaagtaatgatattgttgatagtagtagatagattttttgtagtagggaaatttattaggtgattttgagaaaggataggatatattgagagatattttataaaataattggtttgtattttttaaaagtgttgaagttataaaattttaagaatgatagaagaattattttagataaaggagattgaagaggtataataatggaatgtaaagtttaatttaggatttttttttgttataaatgatattattgggatagttgatgaaatttgtataaaatttgtgggttggataatagtattgaaatggtgtttatgttttggtttttataattgtattggttatgtaagagaatgtttttgtttttaggaaatatatattaaaatatttaataatgtaatatttgtaatttatttttaagagtttaaaaaatatatatttgtttatttatttgtttatattatttatttgtttattgattgagaaggataaagtaaatgtagtaataatttagggaatttggataaaggatatatggaaatttttttttttatttttgtaatttttttgtaaatttgaaattatgtttaaatgaaaagtttgtgggttttttaaaaagggatgagatagaaagtaagtagtattagggttataagttagggtgagagggtaatggttttaggtatttggtagaggtaagagagtagtttagggttagttggttgaaggggtatgtggggttttatggagattttatttatttattttttgatgtatttattatttttttagatttttttttgtaatgttagggaagattttatttttgatgtttggtgtttttatatagttggtttttaggggaggaaatagttttttttatgtgattttgggttagatgtggttttgttatggttgttaaggggtggggtttgggaaggtgatgttgattagaaataataaaattttggaattttttatattagatttaggaaattaggagttaagatgagttgatgtaaaagggatagataatggataatggtatttttttgtttgttatatgagtttaatagtgggtgattaaaagttaggattttatgatttatattatatgtggtttgatattttggttattattaagtttaagtttaggaatttaggttaatttttattgattttagggttttttttttttttttttttttttaagttgaaaaagtaagagatgtttgtgagttttttgttttatattttgaatatataatgtatttatatggtttaaaatggaaaaaaatgttttttgtttattttgttgaattttattattagttttttttagatttttttagagatgttgtatgtattgagaagtaaataatgtattattattattattttgttatttagtttttattttataattataaatttaattttgtaatttagttaggtatggaagggaataaggaaaatatggaatttaaagggaattgtagtgagagtataaagattttaggatattgggagtaaatggggtggagggtgtttttttgagttatagaaggaatggtttggtggttaagataaaatataagttaaatttataagagttgtttatagttagtaatggtgattttttggttggttttgttatttttggatataaagtattttatggtttttataatatttatgtttttattttgttaaagattataagtttgttatttaattatttagttttggtagtgtagattaaaaattgggaattatttgtattgggtttagtatttgttatggataatatgttaggatttgtatgttttaggatgaagtttttattattaaatttttttttatagatggatttgttattagtgttattatggtgtatgaagttattattttgatatataaattttggaataattttgtgaaagtaggaatttttataattaaattttttttttttagtgtttagagtataaaagttttttgttggttttggaattttgtttgtaaatagtttgaaggagatgtaggtttaaaggtttgttgttaatggtgatgttgaagaatatggtggggttgatgatggttgatgttatagggtttttggtggtagtggtatttgtaaagtaaataatgtattattttgttttatttatataatgagagtatattattgtattgtttaggttggtttggaatgtttaggtttaagggatttgttttatttttattttttaaagtattgggattataggtgtgagttattatgtttggtaagatggagttgtttttattgtatatggagaggtggtttagtttttttatagttgtatatattttgtttgtgtggatggtttttaatttatgtaatttattttttatttataggtatttgggttgtttttaatatttttttattataattagtgttgtaaagaataaggttatatagagattattttatttttatatgagtgtatttataggaagaattgaatgttttgaagtggaaatgttgggttaaaaagtataagtttttgtaattttaatggttatttgttttgttttttataggggtatttgtggtattttttaatgatgttatgtttattgaaaggagttagtttggtatagtagtagaaatgttagaggaagagaggagatttttgatattgaaattttaatattatagtaatttgttgtgtgttattgggaatgttgtttttattagttttttatttgaaaagtgagggggttgaataatgatgttaatggttttttttagattaaaagtttagggatgggtaattgtt

SEQ ID NO: 739 - DNA, 5759 bp, Artificial Sequence
  chemically treated genomic DNA (Homo sapiens)
tttatatatattatgttttttaaatgatatattagttttttgagggtaatttatattggtaatagtttttagatgtggaaattgtgaagataatgttggtgatgtggaagtaatataaattttggagttttttagatttaggtttgaatgttagattgttttttatttagagtaattttagagtattattttttattttaatttttttttaggtttttttgtgtttatgtgttttttttatttttgtttattgtttatttagtgatttttgtatttttttttattgttagtgtgtagatatatagtttttttggttttgagatttatgttaattttattttattattttgttagtttatttaatttttattgagtaatgttagttgaaagttgtggtgggattaaatgttgtaatgagtatttaaatgaggttgaagtatttatgtattttatttatatatggtgaggtatatttaaggaaggttgtagttattaaaattttaggaaataattttttatttttttaggtgaaagggtttttaggtttttgtgttttggaaggtttatttatagttattttttaaatgataatgtgattgatgagtttagagtttagtttaaatagtaatggattggaagattagtttaggttttattaatgtggaatatagaataaattatgtttttgttttagtttgtttatttgtgaaatagagtttattatatttagttttttttgtttttaggtttgagttattttttttggttaaggtaagtaaatgtttatgatgtttggttgtgtataagataaagttataataaagttataatttattttttttttgtagaagattgtaaaaagtaaaagagatttaggtaaaaattttggaatgatttttggaatagagagtttttttagaattagaagttaaaggaatttaaaatatagggaggtttagggtttttattgatataaaggaaagatgttttttttataggtttatgtttatattttttttttttttttatttttatttgtatttttatttttatatagggtttatgggattttttttataaaagagtagttgtagtaatttatattattttttatgtttggttgtttattaagaggtgaaaagtagttttatataggttttatttttggatagttttagttgtaaagtttaaaatatgtgaaggtaatttggaaaagtaagtggttgtatataaagtaaatgtttatagagttttggataaaattgagtgtttatgtgtatatggtaagtgtttttagtgtttgtgtgtttatttgtttgtttgggtgattttgtttttgagagtttggatgagaaatgtatggttaaaggtaattttagataggaagaaaggtagagaagagggtagaaatgatttttgatttttggggttgagggtttttagagtaaatggtataatgttatgaggtttgatttatttttatgatggaatttaaggttttagtaagtatttgttggtttggttatggtttgttttttagtttgtaggagatttttttatttttttatttgtgtgtttttattagttttgaaaagaatttttggtagttaggagtaggtatttttattgtttttttttttttttttttgtttttattttgttggttttttagattgggttttggaattaaatttggtgagtgttggtttttaggaaatttggagttttggtgtttaaattttggtttaggaaagtaggagttatttaggaagtaggggttttttagggttagagttagttttttttgtttttgtttatgttgtgttagtatttgtttttttaaagttattaggtaggtgttagtgtgtggtgaggggaggggagaaaaggaaaggggaggggagggaaaaggaggtgggaaggtaaggaggttggtttggtgggggtgggatttgatttgtaaattgttgtatttgttttttattttttagtgttttttttgagattttggggagttagtttgttgggagagtgggatggtttggagtaagtttagaggtagaggaggtgatagagggaaaaagggttgagttagttgttttagtgttgtataggagttgaagggatgtattatgttagttttagtttggttttagtgatagttaatgttttttgtagtgtggtggttttgaagttgttgtttggagttgtttttttttttttggtgaagtttttaaaagttgttaaagatttggaggaagtaaggaaagtgtttggtaggattgatggttgtttttgttttttttttttttattttgtttttttttattttgtttttttttttttttttgtttttttttttgtagttgttttagttggttatttttagttaattttttttattatttttttttttatttgtttttttgtttttgttggtttagtgttgttagtttgagtttgtagagaggtaattttttttggttgtgagtgggtgagttagttgtatattgtaaagaaggtttttaggagttaggtgattggggagtggttttagtattgtagttatgatttgtttggttaggttgtatgtggagagaattttttgtttttttttattttttttttatttttttttgttttttttattttgagtgtggagttagagattaaaagatgaaaaggtagttaggtttttagtagttaaaaaataaaataaataaaaataaaaaagttgaaataaaagaaaaagataataatttagtttttatttgtatttattttagtggatattgaatttggaaggtggaggattttgttttttttttttaagatttgggtattttttgaatttattttttaagtattaagagatagattgtgagtttagtagggtagattttgtttattgtgtgtttttttttgtatgagattttgaggttgttagagtgttttttgtgtggttgtttttgtaagtttttttttttggagttttttgtaggtgggtagttagttgtagtgattattgtattattatagtttgttgaatttttttgagtaagagaaggggaggtggggtaagggaagtaggtggaagatttagttaagtttaaggatggaagtgtagttagggttgggaagggtttatttttggttgttgtttaagatttattgaggagttttttagaatttgttttagagtgtgtgtgaagtgatttagaatttgggttttaggtatttagaggttgtgagtgtagtattttttggtgttagtttgttgttgttgtagtagtagtagtagtagtagtagtagtagtagtagtagtagtagtagtagtagtagtagtagtagtaagagattagttttaggtagtagtagtagtagtagggtgaggatggttttttttaagtttattgtagaggttttataggttatttggttttggatgaggaatagtaatttttatagttgtagttggttttggagtgttattttgagagaggttgtgttttagagtttggagttgttgtggttgttagtaaggggttgttgtagtagttgttagtatttttggatgaggatgatttagttgttttatttatgttgtttttgttgggttttattttttttggtttaagtagttgttttgttgattttaaagatattttgagtgaggttagtattatgtaatttttttagtaatagtagtaggaagtagtatttgaaggtagtagtagtgggagagtgagggaggttttgggggtttttattttttttaaggataattatttagggggtattttgattatttttgataatgttaaggagttgtgtaaggtagtgttggtgtttatgggtttgggtgtggaggtgttggagtatttgagtttaggggaatagttttggggggattgtatgtatgttttatttttgggagttttatttgttgtgtgttttattttttgtgttttattggttgaatgtaaaggttttttgttagatgatagtgtaggtaagagtattgaagatattgttgagtattttttttttaagggaggttatattaaagggttagaaggtgagagtttaggttgttttggtagtgttgtagtagggagttttgggatatttgaattgttgtttattttgtttttttataagtttggagtattggatgaggtagttgtgtattagagttgtgattattataattttttattggttttggttggattgttgttttttttgttgtttttttatttttatgtttgtattaagttggagaatttgttggattatggtagtgtttgggtggttgtggtggtgtagtgttgttatggggatttggtgagtttgtatggtgtgggtgtagtgggatttggttttgggttatttttagttgttgtttttttattttggtatattttttttatagttgaagaaggttagttgtatggattgtgtggtggtggtgggggtggtggtggtggtggtggtggtggtggtggtggtggtggtggtggtggtggtggtgaggtgggagttgtagttttttatggttatatttggtttttttaggggttggtgggttaggaaagtgattttattgtatttgatgtgtggtattttggtggtatggtgagtagagtgttttattttagttttatttgtgttaaaagtgaaatgggtttttggatggatagttattttggattttatggggatatgtggtaagtttttttttttagaaatgttgttttttggtttagggtagagttattttgtgttttggggtatttagtggtttttatttgtgtgaatatttagattgtttttgggagagtttagtagggtaaatttagagtttttttgtggatttttggtttgttagaggtttaatttgagtttttttaatttttgttgtgtgttttgggtgttgatttttgtttttttagattttttaatttttttaattgttttaaatttttattattttttggtatttgaggttttaaatagaaattttattgtatgggttatttttagagataaagtttttaagttttttattttttttttttttttgtttttaaagtttgagaattttaataggaatttgggtaattttttttttttaggtttgttaggattttatttttagtttgtgtagattagagttaaaaagattggtttaatagttttttagtgggtattttttagagaggtaaagtgaaatttttggttagggaaagaaagtggtttttgggtgttgaggtttgttgtgtgaaagggtgaattttttttttttgaagtaattggggatttgttttagggttggaggttagtagagataatttaaattgttatgtttagagtaggtagaggggtaatttttttggtaaagattttataggatttgtatttatagttttttaatgttggttgattatgttgaaagtagttgtttgggttggtttttttttgtaaagtgtttattttttttgtggattataatagatttatagttttttattttaggtttgtattagatttataaagaggagaatatttttttaatgtataatttaattaggtttgattttgatttataaaattgttggaaaatatttttttgtaaagtattttttgttattttagtgtgttttaaaatttttattggggagggtggagtgaggttttttattatatttttttatttttaggatatgtttgtattttagaatatgtgtagttagtt

SEQ ID NO: 740 - DNA, 5759 bp, Artificial Sequence
  chemically treated genomic DNA (Homo sapiens)
agttaattgtatatattttaaaatgtaaatatgttttaaaaataaaggaatataataaaaaattttattttattttttttagtggagattttggagtatattgaaatagtaggaaatgttttataaaaaaatgttttttaatagttttgtaagttagagttaagtttaattaaattgtatattaaaagaatatttttttttttatagatttgatgtaaatttgaagtagggggttgtggatttgttataatttatagagaaaataaatattttataagagaaaattgatttaagtaattatttttaatatagttaattaatgttgagaaattgtgagtgtaaattttgtgaagtttttattaagaaagttgtttttttgtttattttaaatatgatggtttggattatttttattgatttttagttttggagtaagtttttagttgttttaggagaaagaagtttatttttttatatagtagattttagtatttagagattattttttttttttaattgagaattttattttatttttttggaggatatttgttgagaagttattgggttggtttttttgattttaatttgtgtaggttgaaagtgaaattttaatagatttgaagaggagaaattgtttaaatttttgttgaggtttttagattttgaggataggaggaaaggaagagtggagggtttgggagttttatttttgaaggtggtttgtgtaataggatttttgtttgggattttgagtattaggaggtagtgagaatttggggtggttgggggagttgaagaatttgggagggtaggaattagtatttagggtatgtagtagaaattaggagagtttaggttaaatttttggtaggttgggagtttatgggagagttttaggtttattttgttgagtttttttaggggtaatttgagtgtttgtgtaggtaggagttgttagatattttagaatatagagtgattttgttttgggttgaaaggtgatatttttggaaggaaaaatttattgtatgtttttgtaaggtttggagtagttatttatttaggggtttattttgtttttgatataagtgggattgggatagggtattttgtttattatgttgttagggtattatatattaggtgtggtgaagttgtttttttggtttgttagtttttgagggggttgagtgtagttgtagggggttatagtttttgttttgttgttgttgttgttgttgttgttgttgttgttgttgttgttgttgttgttattatttttattattattatatggtttatataattggttttttttggttgtgaagagagtgtgttaggatgaggaagtggtggttgagggtgatttagaattgggttttgttgtatttgtgttatgtaggtttgttaggtttttatagtggtattgtgttgttgtagttgtttaggtgttgttgtagtttagtgggttttttagtttgatgtgagtgtggggatggggaggtggtggagggggtggtggtttggttagagttagtggaaagttgtagtagttgtgattttggtatgtagttgttttgtttagtgttttggatttgtagagagatagggtagatggtagtttaagtgttttggagttttttgttgtagtgttgttagagtagtttaggtttttgttttttagttttttggtgtaattttttttgaaaggggaatatttagtagtatttttagtgtttttgtttgtgttgttgtttagtagagaatttttgtatttggttaatggggtataaggagtgggatgtatagtgggtggaatttttaaaagtggggtgtatatgtaatttttttgaagttgtttttttggatttagatgttttaatgtttttatatttaggtttatggatattgatattgttttatataattttttggtgttgttagaaatggttgaagtgttttttaagtaattgtttttggaggaagtgggagtttttgaggttttttttgtttttttgttgttgttgtttttggatattgttttttgttgttgttgttgaaggagttgtatggtgttggttttgtttaggatgtttttaaggttagtggagtagttgtttaagttggggaaagtggggtttagtagggataatgtggatggggtagttgagttatttttgtttggaggtgttggtagttgttgtggtagttttttgttggtggttatggtggttttaggttttgggatgtaattttttttggggtggtattttagggttgattgtggttgtgaaggttgttgttttttatttaggattaggtagtttgtggggtttttatgatgggtttggggagaattatttttattttgttgttgttgttgttgtttggggttagttttttgttgttgttgttgttgttgttgttgttgttgttgttgttgttgttgttgttgttgttgttgttgttgtagtagtagtaaattggtgttgggaggtgttgtgtttgtggtttttgggtgtttggggtttgggttttggattattttgtgtatgttttggaatagattttggaaagttttttggtaggttttggatggtggttgagggtagattttttttagttttaattgtatttttatttttgagtttggttgaattttttatttattttttttattttgttttttttttttttgtttagaagagtttaataggttgtgatgatgtggtagttgttgtagttagttgtttatttgtgggaagttttagagaaggaaatttgtgggagtaattatgtaaaaagtgttttgatagttttaaagttttgtgtagaagaagatatatggtggataagatttgttttgttaggtttatagtttgttttttaatatttgaagggtagatttaaaagatgtttagattttaaaagaaaaaaataaaattttttattttttaaatttagtgtttattgaagtaggtgtaaataagaattgagttattattttttttttttattttggtttttttgtttttgtttgttttgttttttggttattgaagatttgattgtttttttattttttgatttttggttttgtatttggggtggggaaggtaggaggaggtggagagagagtgggggaaaatagagggttttttttgtgtgtagtttaattaggtgggttgtggttgtagtgttgaagttgttttttagttgtttggtttttaagagttttttttgtaatgtgtagttagtttgtttgtttgtagttaaagggagttatttttttgtaaatttgggttggtagtgttgggttgatgggggtgggggggtgggtggggagaagggtggtgaggggggttggttgagagtagttgattgaggtagttgtgggagagaagatgggggagggggggaaggtagggtggggggaggtggggtggagaggaggaggataaaggtagttgttagttttattaggtattttttttgttttttttgagtttttagtagtttttaaaaattttattgaagaggaaagggtagttttgggtggtggttttgaagttgttgtgttgtaagaggtgttggttgttgttggagttgggttggggttggtgtggtgtgtttttttggtttttgtatagtattggagtggttagtttggttttttttttttttgttgttttttttgtttttgggtttgttttggattgttttgtttttttagtaagttggttttttgggattttggagggggtgttgggaggtggagagtaaatgtaatagtttgtgagttgggttttgtttttattgggttggtttttttgtttttttattttttttttttttttttttttttttttttttttttttttttttattgtgtgttaatgtttgtttagtggttttggagaaataagtgttggtgtagtgtgggtgagggtaggagaggttagttttagttttggaggatttttgttttttgaatagtttttgtttttttaaattaaggtttaggtgttagggttttagattttttggaggttagtatttattaaatttggttttaaagtttaatttaaaaaattaatagggtggaggtgagggagggaggaaaaggatgataggaatatttgtttttggttgttaggggttttttttaggattgataagagtgtgtagatgggagagtgggagagttttttataaattgaggagtaagttatgattaagttagtagatatttgttgaaattttagattttgttatagggatagattgggttttgtggtattgtgttatttgttttaggaatttttagttttaagaattagaggttatttttatttttttttttgtttttttttttgtttggaattgtttttaattatgtattttttatttagatttttaaaggtaaaattatttagataagtaggtaaatatataaatattaaaaatatttgttatgtatatataggtgtttaattttgtttagagttttgtaaatgtttgttttgtatgtagttgtttgtttttttaagttgtttttgtatattttaaattttataattggaattatttaaggatagaatttatatagggttgttttttgttttttgatggatagttaggtgtagaggatgatgtgggttattgtaattgtttttttgtggaggaggttttataagttttgtgtaaaggtggagatgtaagtgggaatggaaagagagagaaaatgtaaatgtaaatttataaggaaaatattttttttttatgttagtagagattttgggtttttttatgttttaaatttttttgatttttgattttggggaggttttttgttttaaaagttattttgagatttttgtttgggttttttttgttttttgtagttttttatagagaaaagatgggttgtagttttgttgtagttttattttgtgtatagttaaatattataggtatttatttattttgattaaagaaggtaatttaaatttaaaggtaaggaagattggatatgataggttttattttatagatgaataggttgaaataaggatataatttgttttatgttttatattagtaaaatttaaattagttttttagtttattgttatttgagttagattttagatttattaattgtattgttatttgggaaatggttataaatgaattttttagaatataaaggtttgaagatttttttatttgaggaggtgaaaaattattttttgagattttaatggttatagttttttttgaatatattttattatatgtaagtagaatgtgtagatattttaattttatttgaatatttattgtaatatttaattttattataatttttaattagtattgtttaataggaattgagtgggttggtaggatggtagaatggaattaatataggttttagagttaggagaattatgtgtttatatattaatagtgaaggaaggtgtaaaaattattgaatgaataatggataggagtgaagaggatatatagatataaagaggtttgaaaaaaaattaaggtgagaaataatgttttgaagttattttgaataaaaagtagtttgatatttaaatttgggtttgaaagattttaaagtttatgttgtttttatattattaatattgtttttatagtttttatatttgaaaattgttgttaatataagttatttttagaaggttagtgtgttatttaaaagatataatgtgtataga

SEQ ID NO: 741 - DNA, 5387 bp, Artificial Sequence
  chemically treated genomic DNA (Homo sapiens)
tttttttaagttttgggatggtaggtatgagttattattgtatttggtttatatatattttgtttatttattttttgatggatatagattatagaatttatagaataatgttgttatgagtaagtttatataaatatatggagatgttattgttatggtagattgttttttggatagggtagataaaagtatttttagttatttaaagaagttgggaagtaagtagttgtatattgtttttaattttttaagtgatttaattttattgttttgtttttatatattttattgtgggattttgtttttttatgatttaagagtagtgtatattttggtttttttaagagatattagtttttatatttgagttttgttgtttttttgggataatattttttattaggggtttattggtagtaaattttagttaggttgaagatgattgttagaaaattataagttttttagtttttttaaatgatatggtattttagatagtatttgtattttttttttaaataaaatttttgttttttggagttaataattgattaataaagggtttaagggtggggggtggtggtttatgtttgtaattttagtattttgagaggttgaggtgggtggattatggggttaggagaatgagattattttggttattattttggttaatatggtgaaattttgtttttattaaaaaatagaaaaaattagttgggtgtggtggtgggtgttagtagttttagttatttggatggttgaggtaggagaatagtttgaatttgggaggtggagtaattagttgggtgtggtggtgggtgtttgtagtttttgttatttggaaggttgaggtaggagaatggtttgaatttgggaggtagagtttgtagtgagttaagattgtgttattgtattttattttgggtgatagagtgagattttgttttaaaaaaaaaaaaaaattaaaaataaataaataaaaataaaataaagggtttagtgtttatttttttttatattgtagatttttaggttgtatttttttttttttgttttttagttattttgttttttttttattttgttttttttgtttttttatttttttgataggttgtattttttttttttgttttttttattttggttgttttgattaattaatttgaagttattttagttttttttaagtgttttttttatttggattagttaatgtttatatattttaggtttaaattaattagggaattttttagtatttttttaaataaggatttattgagttttttaggtttataattaattagatttttattggtttatttagttttttgatgtttttgttttagtttggaaatgtttagattatgtagttttagtgagtaggtgggggtttttttaatattaaattgtataattggggtttttttattttttattttgtttttttttgtaaatttgagatggttttaatttagtaatttttttttaaattggtttatgaggttagagatagtatttttattgtaatgtggttgggtggtgttaatataaatgtttttatttttttttggatgtgtgtaatttgttttttgtattagttttttgtttataattgtgtaggtttagtaagtttttataattaaaagtttagtgttgattttttttgttaattaggtgttgaagtgtaggtggttagtattgttatggagattaatattttttttattgttatttttttttttttttagggtttttgttttttttagtgaattttagaagattttggagagttttgagtagggggtggtattttggtttttgattggtttaaggaaggttggggggtaggatgggaggtgaaatttttggaatatttttgatttggtagttttattgagtttggtgattggtttagaagggaaaaggtgggtttttgtgatgatttataaaagtttaggggtaagtggtttggataatggttagtttgaggagttgttgtgatagtttattattttttttgagagtgatttttgttgttttaaggttttttagagtgaatttgtgtggttgtaggtattggtgtgttgagtttttggtgtttggaaggattgagttttttttgtggatttagtgttttgtttttagtttttaattttagagttgagttgatagagagtagggaattggtatggttaaagttgtggtgattggtattgatttgggtattatttatttttgtgtgggggtgttttaatatggtaaggtggagattattgttaatgattagggtaattgtattatttttagttatgtggtttttatggatattgagtggtttattggggatgtggttaagaattaggtggtgttgaatttgtagaatattgtgtttgatgtgaagtggttgattggttgtaagtttggtgatttggtggtgtagttggatatgaagtattggtttttttaggtgattaatgatggagataagtttaaggtgtaggtgagttataagggggatattaaggtattttattttgaggagattttgtttatggtgttgattaagatgaaggagattgttgaggtgtatttgggttatttggtgattaatgtggtgattattgtgttggtttattttaatgatttgtagtgttaggttattaaggatgtgggtgtgattgtggggtttaatgtgttgtggattattaatgagtttatggttgttgttattgtttatggtttggatagaatgggtaagggggagtgtaatgtgtttatttttgatttgggtgggggtatttttgatgtgtttattttgatgattgatgatggtatttttgaggtgaaggttatggttggggatatttatttgggtggggaggattttgataataggttggtgaattattttgtggaggagtttaagagaaaatataagaaggatattagttagaataagtgagttgtgaggtggttgtgtattgtttgtgagagggttaagaggattttgttgtttagtatttaggttagtttggagattgattttttgtttgagggtattgatttttatatgtttattattagggtgaggtttgaggagttgtgttttgatttgttttgaagtattttggagtttgtggagaaggttttgtgtgatgttaagttggataaggtttagatttatgatttggttttggttgggggttttatttgtatttttaaggtgtagaagttgttgtaggatttttttaatgggtgtgatttgaataagagtattaattttgatgaggttgtggtttatggggtggtggtgtaggtggttattttgatgggggataagtttgagaatgtgtaggatttgttgttgttggatgtggtttttttgttgttggggttggagatggttggaggtgtgatgattgttttgattaagtgtaattttattatttttattaagtagatgtagatttttattatttattttgataattaatttggggtgttgatttaggtgtatgagggtgagagggttatgatgaaagataataatttgttggggtgttttgagttgagtggtatttttttggtttttaggggtgtgttttagattgaggtgatttttgatattgatgttaatggtattttgaatgttatggttatggataagagtattggtaaggttaataagattattattattaatgataagggttgtttgagtaaggaggagattgagtgtatggtgtaggaggtggagaagtataaagtggaggatgaggtgtagtgtgagagggtgttagttaagaatgttttggagttttatgtttttaatatgaagagtgttgtggaggatgaggggtttaagggtaagattagtgaggttgataagaagaaggtgttggataagtgttaagaggttattttgtggttggatgttaatattttggttgagaaggatgagtttgagtataagaggaaggagttggagtaggtgtgtaattttattattagtggattgtattagggtgttggtggttttgggtttgggggttttggggtttagggttttaagggagggtttgggttaggttttattattgaggaggtagattaggggtttttttaagattgttgtttttgttttggagttttaagattttgtattttttagtatttttgtttgttagtttttaattttttgtgtttgtaatgttgaaattttttggtgaagtattgaatttgttttttttttggtttttatatgtagagatgaatttatattgttattttatgattattttttttttttaatatatttaatttaggttattttttaagttggttattttaaagtaaataaattttaaaatttaagtgatgttttttatttttttatttgggggttagtagggtttgtataggttgttttttttatagtgtttaaaatggaatggtatttttgtttttagtaagggtagattttgtagaggtgtgattattgtaatgtgatttatttgtgttagataaatggtattttttagtaaagttttttgattttggttaggagtggtggtttaagtttgtaattttagtattttgggaggttgaggtgggtggattatttgaggttaggagttttagattaatttggttaatgtggtgaaattttgtttttattaaaaatataaaaattagttgggtgtggtggtgtgtgtttgtagttttagggaggttgaggtaggagaattgtgtgaatttaggaagtagtggtagtagtgagttgagattatgttattgtattttagtttgggtattatagtaagattttgttttatatatatatataaaaaagtaaagtttgttgatgttgattgggtttagtttgagggtatagaaaaagtttaatatttgggagggtagttttaaagtgatgtttgtgtaagattggttttaaaagaggtgggaggggggtggggatgtttttgtaaaagtggttaaaaagaatgtagttagatgggaggttagtgtttttattttttgtaggtatatttgatatgtttatggatttgatatttaatttagatttaatatggaatggaaggagtgttttaaattttaaagtgaaaaaatgggtatatttattggtttgttgagttatatatatgtgttttagttgttattttttaaaatggaagggtttggtttgatgttttttttatgattgaaagtatattgaaatagaaatgttatatttttagtagttattatttataatttaagtatgttagtgagtatttgggttaggaagatttatagattttatttttatgtatttttttttggagatgttttatgttttagttgttagtattttagaa

SEQ ID NO: 742 - DNA, 5387 bp, Artificial Sequence
  chemically treated genomic DNA (Homo sapiens)
ttttaggatgttagtggttggggtatgaagtatttttaagggaaagtgtatgggagtgaagtttgtaggtttttttggtttgggtgtttattggtgtatttaaattgtaggtgataattgttaagaatgtgatatttttattttagtatgtttttagttatgagagaggtattgagttaaatttttttattttaaaagatgataattaaagtatatgtgtataatttagtaagttagtgaatgtatttgtttttttattttgaaatttaggatattttttttattttatgttgaatttagattaagtattaagtttatgagtatattaggtgtatttataggaggtaggagtgttggttttttatttaattgtattttttttgattatttttgtagaaatatttttgttttttttttattttttttgagattaattttatataaatattattttaaggttatttttttaggtgttaaattttttttgtatttttaggttaaatttaattagtattaataaattttatttttttgtgtgtgtgtgtgagatggagttttgttgtgatgtttaggttagagtgtaatggtgtgattttggtttattgttattattgttttttgggtttatatgatttttttgttttagtttttttgggattataggtatgtattattatgtttagttaatttttgtgtttttagtagagatagggttttattatattggttaggttggtttggaatttttgattttaagtgatttgtttattttagttttttaaagtgttgggattataggtttgagttattatttttggttagaattaagaagttttattggaggatattatttgtttaatataaatggattatattataatagttatatttttgtaaaatttgtttttattggaagtaaaaatgttattttattttagatgttatgggaaaaataatttatgtagattttattgatttttaaataaaggaataaaaggtattatttgaattttaaagtttatttattttgaagtaattaatttaaaaaatggtttgagttaagtgtattaaaaagaagaaatagttgtaagatggtagtataaatttatttttgtatgtagaaattggaaaaaaagtaagtttagtattttattaaaaaattttaatattgtaaatataggaaattgagaattgataaatagaaatattaggaaatgtaaagttttgaagttttaaaataaaaatagtaattttggaaaggtttttaatttatttttttaatggtggggtttgatttagatttttttttgggattttgagttttgaagtttttaggtttgggattattggtattttggtatagtttgttgatgatggggttatatatttgttttagttttttttttttgtgtttaaatttgttttttttggttaaggtgttggtgtttagttatgagatgattttttgatatttgtttagtattttttttttgttggttttgttgattttgtttttgagttttttattttttatggtgttttttatgttgaaggtgtaggattttagggtgtttttggttgatatttttttgtgttgtattttgttttttgttttgtatttttttgttttttgtattatgtgtttgattttttttttgtttaggtggtttttgttgttggtgatggtgattttgttggttttgttggtgtttttgtttgtggttgtgatgtttaggatgttgttggtattgatgttgaaggttattttgatttggggtatgtttttgggggttggagggatgttgtttagtttgaagtgttttaatagattgttgttttttgttatggtttttttgtttttgtatatttggattagtattttgggttggttgttggagtaggtggtgaagatttgtgtttgtttggtggggatggtggagttgtgtttgattagggtagttattatgtttttggttgtttttagttttagtgataggggagttatgtttagtagtagtaggttttgtatgtttttggatttgttttttattaggatggttgtttgtattgttgttttgtaggttatagttttgttggggttgatgtttttgtttaggttgtgtttgttgaagaagttttgtagtagtttttgtattttggggatgtgggtggagtttttgattaggattaggttgtgaatttgggttttgtttagtttggtgttgtgtagagttttttttatgggttttagggtgttttggaataggttggagtatagttttttgaattttgttttggtgatggatgtgtagaagttgatgtttttaaatagggagttgatttttaggttggtttgggtgttggatgatagggtttttttggtttttttgtaggtggtgtgtagttgttttatggtttgtttgttttggttgatgttttttttgtgtttttttttgaatttttttatgaagtggtttattagtttgttgttaaagttttttttatttaggtgggtgtttttggttgtggtttttattttgaagatgttgttgttgattgttaggatggatatgttgaaggtgtttttgtttaggttaaagatgagtatgttgtgtttttttttgtttgttttgtttaggttgtaggtgatggtggtggttgtgggtttgttgatgatttgtagtatgttgagttttgtgattatatttgtatttttggtggtttggtgttgtgagttgttgaagtaggttggtatggtgattattgtgttggttattgggtagtttaggtatgttttggtgattttttttattttggttagtattatggatgagatttttttggggtagaatgttttggtgttttttttgtagtttatttgtattttgggtttgtttttgttgttgattatttggaaaggttagtgttttatgtttgattgtattattgggttgttgaatttgtggttgattagttgttttgtgttaaatatggtgttttgtgggtttagtgttatttggtttttggttgtatttttgatgagttgtttggtgtttgtgaaggttatgtagttgggggtggtgtggttgttttggttgttggtgatgatttttattttgttgtgttggaatatttttatgtaggagtaggtggtgtttaggttgatgttgattgttgtggttttggttatgttggttttttgttttttgttggtttggttttgagattgggggttggaaatggaatattggatttgtgagaagagtttggtttttttggatgttggaaatttgatgtgttggtgtttgtagttgtataggtttgttttgggaagttttgggataatgggagttatttttgaaaaaggtagtggattgttgtagtagttttttaggttagttgttatttggattgtttgtttttgggtttttataagttgttatggagatttgtttttttttttttgagttaattattgagtttgatgaggttgttaggttgggaatattttaggggttttgttttttgttttgttttttagttttttttggattaattagaggttagagtgttgttttttgtttagaattttttagagttttttgggatttattggaggggatagggattttgagaggaagggggagtggtggtgggaagggtgttggtttttatggtgatgttgattgtttgtgttttagtgtttaattgataggaagggttggtgttgggtttttaattgtgggggtttgttgggtttgtgtagttgtgggtagggggttggtgtggggagtgggttatgtgtgtttaggggagggtgggggtgtttgtgttgatattgtttggttatgttataatggagatattgtttttgattttatgggttagtttggaaaaagattattgagttggagttgttttaaatttgtagggagggatggggtggggggtggggggattttggttgtgtagtttgatattgagggagtttttatttatttgttggggttgtgtaatttggatgtttttaaattgaagtgaaggtgttgggagattaggtgagttagtagggatttgattgattgtgaatttgaaaggtttagtaggtttttgtttgggaaagtattggaaagttttttagttggtttaagtttgaggtatgtgggtgttggttgatttgggtaggaggagtatttggggaaagttaagatggttttagattgattggttggagtagttagaatgggggaggtgggggaagggagtgtggtttgttggggaaatggggaggtggggaaggtggggtaagggggaggtggggtaattgggaagtgggggaaagggagtgtggtttaggaatttgtggtgtggagagggatagatattaaattttttattttatttttatttatttatttttaatttttttttttttttgagatggagttttgttttgttgtttagggtggagtgtagtggtatgattttggtttattgtaagttttgttttttgagtttaggttatttttttgttttagttttttgagtagtagggattgtaggtgtttgttattgtgtttggttaattgttttattttttgggtttaagttatttttttgttttagttatttgagtagttggaattattggtgtttgttattatgtttagttaattttttttattttttagtagagatgaggttttattgtgttagttaggatggtagttaggatggttttgtttttttgattttgtgatttgtttgttttggttttttaaagtgttgggattataggtgtgagttattgttttttgtttttaaattttttattgattagttattggttttagaaaataggagttttatttaggagaaggatatagatattgtttggagtgttatgttgtttgagaaaattggaaggtttgtggttttttagtagttatttttagtttgattggaatttattgttggtgaatttttaatagagaatattattttaggaaggtagtagaatttaagtgtggaggttgatgttttttgaagagattagaatgtatattatttttgggttataaagagatagaattttatagtaaaatatataggaataggatagtagaattaggttatttgggaaattgaaaataatatatagttatttgttttttaatttttttgagtagttgagaatatttttgtttattttgtttaaaaagtagtttgttatgatagtagtgtttttatgtatttgtataggtttgtttatagtaatattattttgtaaattttgtaatttgtatttattgagagatagataagtaaaatgtatataggttgggtgtggtggtggtttatgtttgttattttagaatttagggaga

SEQ ID NO: 743 - DNA, 4098 bp, Artificial Sequence
  chemically treated genomic DNA (Homo sapiens)
aatatatgggttgtttaatgttttttattttaaagtatatgtttattttattagggtattaggttatgtgttaatgtaatggtaggtaatttgaagggttttattatgtatgtgttgaatagaattaaagggggggttttatattgtttgtttttgatgaagaaaaagatgtagaaaagaaattgttatatgtggagaattagtaggtgtaagttaaggatagtttgtggtaaattgttattttggaagttagtatttattattttggttttttggagtttgggtgatttttggtattgttatttttgtataaaagtagtggatttaatttttatagaggtagtgttttgtattttttgaagttgtttttagttatttaaagagatgtttttattatggtttaatttatttgggttgtaaattgttgaagtgaagggtttttttttttgtattttttttaagttttgttggtagggattataataaattattatattatgatgttgaaagtttatttttaaaaagtttttaatttagtttgatgagattaatggtgtttaattgtatagtgttgggtatataatgggaagtttaaaaatatagttattattggaataaaaatttaggttgggtgtagtggtttatgtttgtaatttgagaattttgggaggttgaggtgggtggattatttgagattagatgtttgagattagtttgggtaatatggtgaaattttgtttttattaaaaatataaaaattagttggtgtggtggtggatgtttgtagttttggttatagagagttaagattgtattattgtattgtagtttgggtgatagagtaagattttgttttaaaaaaaaaaaaaaaagaaaaaaaaattagttaagatttggaaaaagaaatttaaaaaaggaaaatttatgtagttagtaattattgggatattatttattaggtattatgttaaattggggttaggtgttgagtaaaattaggtttttttttagatggttttttaggttttatgattatagtttaggtgatattggtatttgtgtgttttatagtttgttgaaaaatatttgggaagtaaatattgagaagaaaatattttttttgtgggtttttaggaaaattgagtgattttttttgtgaggggaatttatttttgtaagtatttgtggaaatggtagttttattattgttgggaagggttttttgagtgtgtgttttatttgagttttgagttgggtgggttatgttttgttaattttgttgtttgtagtatttgtaggtgttgagtgaggtattgttgtttggttggggttttttggatttggggaaattgaggttgttttttttggttttttgtagtggggtagtgttgtttatttattttttgttttttgtgtatgtttttgtttttttttttttaagtagggaagggtttatgtgggttatagtagagaggttatgttgtttgtggtgatggttggttttggggagggggtgttgttattgttattttgtagtttgtgttttttatattttgttgtaggtgtagtggattggtggagtgatgttgggagattgattgagaagaatttggaagaatttggttagatagggaagtgggtggggatgggagggagggaggaagggttaagggaggttgttggggagattttgagtttgagggttttaggagaagggggagggggtaggtagttagaaggaggtaagaattaaaaaaaaaaaaagaaaaaaaaattttgaagtgtttgtagtattgagtttgaattggtttagttttgttgtttttagaaagttttgtattttgttttttttgtttgtgtttttgttttttttagttttttttttgtggtggggtgggattaattgttttttgagttgtttttgatttatttattttagtttttgtgttgtgtgtagaggtgtttaagtttttttgtggtttgtagttagtgttgttgtgtttggttttttgtatgttttgtaggtagtgtttttgtttgtggtttagagtgtgtttgtgttggtattagtttttggataaatggtgtgttgtgtggagatgatagttgaggagatgaaggtgattgagagtggggtgtagttggtgttgttgtttatggagggagtggatattagttttaaataggatgaaggtgtgttgaaggtgaggggtggtggggtttgtggaggtgttggaatttggggttttgtgggttgtttttttgttgtgtttggagtttgtggttgggtatgggttgaggtggttgtttttgtagttttgtggttgttttgttgggggttggtggtattgttgttttggattgggttgtgttgtttaaggtattgaggttggttatgtgtttggtaggggggtggtttaggtgtgtgggttgaggttttaggttttttagttggtagtgtttgggtttgggtagggggttgggattgtagtgtttattttggtgtgtgtggggtggtggagaggggtggggtgaggtgattgttgtgggtatttgagttgtagtttggggttaggttgggttttttatgttatgttgtttttgattttgtggttttagtggagttgttagttgtgggttgttttgttggtggtggtgttagggtttgtttatttgggtggtggaatatgggttaggatggggagtgattttttatagtgtttttttggttttttggtttttgtgtgatgtaggtgtgatagggttttggtgtttttttggggttttttgttgatgttgggatttagtgaggtttttatttgttgtgtggtgtttttttttttggttttggggaggttgggtgtggggtatgttgggagttgtagtttttttttttttttgttgttttttggagttagggttgtggggtgtggggtggggaggaggtgttttgttgtggagtttgttgttgagtgattgtttgattataaatagtttggggagttgtggggagggtattttgatttgggttaggataatttgttttgggttggagtaggttttagggagaattagagatggtgaatttttagtttgtgttttatgttttttttttatttgttgttgtgtttttattttggttttttattgttgagttttgtgtgtgtggtatttattttagggggtttttatttggtttagaagtgtatttgtttttgtattagattattggggattttaagtgtttgttttagtggtttttttgtggtatgtgattttttttttttgttttagtgttttgttgttttttatgagattgttattttaggaaagtttattttttttttgatttattatttttttttttttatttttttattttttaaagtttttgtttattttttgtggaagtttttttttggagggtaattatatatttattaggtggtgttaaagaagtttttatgtttttgggaaatattttagttttggattaattattagaggaatatttagtttttaagttagagtttaaggttttatggagagtttttgggtttatttataatttggttttttttttatttgttttgaattgtttttattttttttatttatattttttttgtttttttgtttttaaattagattttagtttgatgattattggtatgaaggaagaaggaggaagtgtggtataaatatttttttttttgttgattataataataatttattatttaattttttattggtttaattttttaataattgtaggagatagggattattattattgttttataaataaagtgtggagaattttaaaaatttattatatagtggaaatttgaatttagattttttagttttttgtttttttttttaaattaagttttgttgtattttaagaaagataagaaggttagttgatttataagttaagttgttagtaattgaatttggagggataagtaggtagaggaggatgaatatagagaagtttttttatgttttttttggaggtttgtaggtagtgttggtgtttttttttgttttaaattttggggtatttatttttttttttttttttttagg

SEQ ID NO: 744 - DNA, 4098 bp, Artificial Sequence
  chemically treated genomic DNA (Homo sapiens)
tttgggaggaagggggagaaagtgagtattttagggtttggggtagaaaggggtattagtattgtttgtaagtttttagagggaatataaagggatttttttgtgtttatttttttttgtttatttgtttttttagatttagttattagtagtttggtttatgagttaattaatttttttgttttttttgaggtgtagtaagatttggtttgaaaaaggagataaaaggttgagagatttgagtttaagtttttgttgtatggtaagtttttaaaattttttatattttatttgtaaagtagtgatgataatttttattttttatagttgttggaagattagattagtaaaaggttgaataatagattattattataattggtaaagggggaagtatttatgttatattttttttttttttttttatgttagtggttgttagattaaggtttggtttggagataggagagtgagaggagtatgagtgaagagaatagaaatagtttaaaataggtaaggaagaaattaggttataggtgaatttggaggttttttatgggattttaaattttgatttgggagttgagtatttttttggtagttagtttagggttggagtattttttagaaatgtaaaggtttttttagtgttatttggtaggtgtgtggttattttttaagggaaagtttttatgaagaatagataggggttttgaggagtagaaaggtaaaagggaaggaatgatggattaaaggggaaatgagtttttttggaataataattttgtagaaaatggtaggatgttggagtgagaaggggaagttatatgttataggagagttgttggagtagatgtttgaggtttttaataatttggtgtaaagatagatgtatttttggattaggtaaaggttttttgaggtgggtgttgtatatgtggagtttagtggtgggaagttaggatgaggatgtagtagtggatggggagaaggtataagatgtaggttgggaatttattatttttgattttttttggaatttgttttgatttaaggtaggttgttttggtttaggttaagatgttttttttgtagttttttaggttatttgtagttgagtggttatttggtggtaggttttatagtagagtgttttttttttgttttatattttgtagttttggttttgggaggtggtggaggggggaggggattatagtttttggtatgttttgtgtttggtttttttggggttgagggagggggtgttgtgtggtgagtggggattttgttgggttttggtgttggtaggggattttgggagggtgttggaattttgttgtgtttgtgttgtataaaggttgaagggttaggaaagtattgtggggagttgttttttgttttggtttgtgttttattgtttgggtgggtgagttttggtattgttattaatgaggtggtttgtggttggtagttttgttggggttgtgaggttgggggtggtgtggtgtgggaggtttggtttggttttgggttgtggtttgggtgtttgtggtggttgttttgttttgtttttttttgttgttttgtgtgtgttggggtgggtattgtaattttgattttttgtttgggtttgggtgttgttggttggggagtttggggttttggtttgtgtatttaggttgtttttttgttgagtgtatggttggttttggtgttttaaatgatgtagtttggtttgggatggtgatgttattggtttttggtgggatggttgtgaggttgtaaaggtggttgttttgatttgtgtttggttgtgggttttgggtgtggtggaagggtggtttgtggggttttgggttttgatgtttttgtaggttttgttgttttttatttttagtatgtttttgttttgtttggggttgatgtttattttttttatgggtagtggtgttgattgtgttttgtttttggttgtttttatttttttggttgttatttttgtgtggtgtgttgtttatttgggagttggtgttggtgtgagtgtattttgggttgtgggtgggggtgttatttgtggggtgtgtgggaggttgggtgtggtggtattgattgtggattgtgaggaggtttgagtatttttgtatgtggtgtgagagttggggtaggtgggttaggagtggtttggggagtgattggttttgttttgttgtgagggaggggttgggaggagtgggagtgtagatagagggggtggggtgtagaattttttagagatggtgggattgagttggtttgggtttagtgttgtgggtgttttggaatttttttttttttttttttttttggtttttgtttttttttggttgtttgttttttttttttttttttgggatttttggatttgggatttttttggtggttttttttggtttttttttttttttttttatttttgtttgtttttttgtttaattggatttttttagattttttttgattgattttttgatattattttattagtttgttgtgtttgtggtggggtgtggggagtgtaggttgtgggatggtagtggtggtgttttttttttgggattggttgttattatgggtggtgtggtttttttgttatgatttgtgtagatttttttttatttgggggaaagagggtaagggtgtgtgtggggagtggggagtgagtggatagtgttgttttgttgtagagagttggggaaagtgattttgatttttttagatttgagaagttttggttaggtagtgatgttttgtttagtgtttgtagatgttgtgagtagtggggttggtaaggtatggtttgtttagtttggaatttagatggggtatatatttaggggattttttttggtggtaataaaattgttgtttttgtgaatgtttataaagatgggttttttttatgaaaaaagttatttggtttttttaaaggtttatagaaggagtattttttttttaatgtttgttttttgagtgttttttgataggttgtggagtgtgtaggtgttggtgttatttaagttatggttgtgggatttagagagttatttagagaggggtttggttttgtttagtatttaattttagtttagtatagtgtttggtgagtgatgttttaatagttattggttgtatgaattttttttttttaaatttttttttttaagttttggttgattttttttttttttttttttttttttgagatagggttttgttttgttgtttaggttgtagtgtggtggtgtgattttggttttttgtagttgggattataggtgtttgttattatgttgattaatttttgtatttttagtagagatggggttttgttatgttgtttaggttggttttgaatatttggttttaaatgatttgtttgttttggttttttaaagtttttggattataggtgtgagttattgtgtttagtttgaatttttattttaataataattgtatttttggattttttgttatgtgtttggtattgtgtgattggatgttattagttttattaaattaaattgaaagttttttagagatgaatttttagtgttataatgtgatgatttattgtagtttttgttgatggaatttgaaagggatgtagaagaaaaagttttttgttttagtaatttatagtttaaatgagttgagttataatgaagatgtttttttaggtggttggagatagttttagaggatatggggtgttgtttttgtaggggttaaatttattatttttatgtagaagtaatagtgttaggggttatttaaattttgggagattaggatggtgggtgttggtttttggggtggtagtttattgtaaattgtttttggtttgtatttattgattttttatgtgtggtggttttttttttgtgtttttttttttattggaagtggatagtgtgggattttttttttaattttgtttggtatgtatatagtggagttttttagattgtttgttgttatattaatatatagtttaatattttagtggaatgagtatgtgttttggagtaagggatgttgggtggtttatgtgtt

SEQ ID NO: 745 - DNA, 13286 bp, Artificial Sequence
  chemically treated genomic DNA (Homo sapiens)
tattgggttttttttttattaggtggttttaggtagttgatagaagttttgtgagttttaatttttttattggaaaagtggagttaatattttattgagttggtgtgaggattaaatgagatgttgtgtaggtgtttagtatagtgttaggtatgatgttaatattgatagatgtattttttttatttttatttatttttttttgtttgttggtttatggttgaaatttttttatgatggtttttatttttagagatattttgttaataagtatatattattaaatgaagttgatttttttttttttttttttttttgagatagagttttgttttgttgtttaggttggaatgtagtggtgtgattttggtttattgtaatttttgttttttatgtttaagtgatttttttgttttagttttttgagtagttgggattattggtatgtgttattatgtttagttaatttttgtatttttagtagagatgaggttttattatgttggttaggttggttttaaatttttgattttgtgatttatttgttttggttttttaaagtgttgagattataggtgtgagttattatgtttggttatgaagttgatttttttaaattattatttaatattttttttataaggtggtaaggaggaagagtatatggggattgggtattttgagagattttaggataggagatagggaggttgagattggtatgttgtttgttgtagttatttgttagtgatatattttttttgtttaaattaatttttttgttttaaggatagggagattttgttttttaatttgagagaaattaggatttttagttttaatgaaaattggatttagggtggggtagtggagattttttatagttattgtttagttgatgaagtagatgtttttttatttttggagtttgtttttattatttgtggattttatttttattaatttagagtatatttgtgtttttttattttggttaaatattaaatagttgaggttggtattgtaaaattttttttttaaatgtttttttttgtttttttttattagagatttggattataatttttaaaaattatgttttttatgttatttgagtagatggtttgatgattaattaggtatagatgtgatattggggggtttttataatggtttgtgggttatatgttatttttttttttatttttattagtaatagttgttttaaagttagttaagattgtggttttagttttgtattttggggtttttgttggggtgggtgaggggaatattttattaagttgggggaattggggttgttattagggggtgtgaggggtttttgtttgagaagaggggtgggtaggtgtttttagtggagaagggtgttgtggttggaggtataggtttttttggtgttattttaagtgagtttgaggaagtatttgggatttttgatttaatgtgaaaggtttttttagtgattttttgagagttgagaatttattttttttatttttagtttatggttttgttattttagggtttgaggttatgtttgttgttggggatttgataaatttaaagtttttttggttttattattggttttttagaattagatatttgttttgaatgatatttatgtgagttaggggttgaggatgtgatttttgaagtgtggtttttagattggttgtattagtgttggtattttttaggatttggttggaaatgtatatttttaggttttattttagattttttaaatttgagattggggttgtggggagtgttatttgtgtgttattatttttgtgggtggattaggagttggtttgagggtgtttttatttagaggttatgtgtggtgttgggtgtttttgagattgttgggttttttggtttggttatgtgggtttaggtattatttttttttattttttttttggtttttaaaaggaagaaggggtttattgttaagttgtttgtgatttttttagtttttttagttgttggttttttggatatttatttttttgttaggaggtagttgtaagtgtggaggttgtgagaaataattgttttttgaaatttgtagggtgaagagtaggtggtgagtgttgggttggggagggattatttgagttgtgatgggttttggggttgtggggtagggttggtgtttggagtttgagttgtaggaggtgtgtttgttttttttaataggtggtggtggggtgtgtgttgggagattttttttaatgtgggaaaagtatgtgtttgtattttagagaaggtaaggttggtgtgtttatttgtaaggtaagtgtttttttgtttgaggtgtggtttaattgttttattttgtttgaaattttgtggtgagaaattagttgtgttgagaataataaaagattaaaaaatgattattaaaattaattgttttgaaagttattggaaagttggaaaatgtatgttttgattaaatgtttttatttaagatattggtaagttaatttatttagtttgtgttgtgagttttgggttgattgtgttaatatgaataattgaaaaatattttatttttttatggttttttttgatggatttttttattatgggtgaaatgataatggagttgaatatattttttgattgaattttgagggtttgggaagatgtatatgttttaggtaagatgataggggttttaaaatgtattaattggtattttttagttatgttagtaagttgtgtttttttttttttgggtagattaagttaagttttaattggttttttttatttgttgaagaggagtttaataattgttttttaatattttgtgtgttatttttattggaaggataatattaagttaagtgaatgttatttttgtgaaaaaattttgagtggatttttatttaggaagataaggttgatttaattttatttgttgtttaaaaagtaggattgtgttttggtgtggtaggtaatattttggaggatagattttgttttattttgttatatttttagtatttatatgggtattttattagaaagttttatttttgttttaagttttgtaatttggtgtttagtgaggggaaatatgtttgtaatttaaaaagtgaatatgtgaaaggaaaggtttttttgagagtgttgtaaaataaatgtaatgtgattatgaaaagaatatgattaatatttttgatttttattttttttgaagaaaatgtattttgatatgagttttagaagaaggaaattataaggatttgtttattaataggtattagagtatatattgtaggattgtattttatgtttaagtatttttttagatgaatttttgaaatatttttattttaaaagttattagatgtttgttaatatttaagttttgtttaagatatagaagtttttgaaattaattaatatgtttaggatatattttgtagtgttttgagggatgtgaataaatttaattatagtttatattttttaatgtatttataatttagaaaaggtagaatttagtagtaaatttaatttataattatataattaatatttaatagatattgatatgtttatttttaagaataagaaggaaattttttataagtgtatgttgaatatataataatttaaaatttatgtgataattttaggtgatgttttgagttgttttatagaatataaatatggataaaatataaaatattgaaggttgaatttaaagtgtttaatgataagtttttgataatatatttagaaattttgagaattgtatgtttgaatgttagattttataatttagtgtttagtatattgttttatatgtaatagtattttaaaaaaattaggttatagtagtataatttatatatagtaaaatttagtttttgtaaatgtatttttatgaattttgatagatgtatagttatgtaattagtattgtatatatgatatagaatagttttattattttaaaagttttttttgtatttttatttattttattgtttttgaaaattattgattaaaattatataatgattatgtggttttgttttttagtatgtttttatttagatatatttttttttattttttttgaaagaaaaatttgtttttttttttttataggatgagttagtttgtgttatttttaattttagtattttgggataaattaaggtaaagataatgttatttgtaaatgggaaatttgagatttggattaagtgttaaatttatatagggttaatagatttagtttttagtagatttagattttattgtggtttaagtttttggttatggtatatattattagttattttgaattgaaatataaggttattaaaagttatttatattatattaatagaatgtattatttttttataatttttgaattttaaaatttttttattaaaaaaaaaattattttttattatatttgagattaagaaagttatttgaaattgtatattattaaatagtgagaagtaaaatagggattgaaaatgataaattgaagatatttaaaatgtagagtgattataattgttgaaggtaaaatatttatttttataggggtttaggtttgtgtttaatttatttgtagatgttaggatttttaaatttttgtgtttatgttttgaagtttagatttttttgtagggtggagatgtataattttttgtaaattaatattttttattgtttaatatagtatttaatttagtatatagttaggagtttgttattggtaggtattgttaatatatatatatataaaattgatgtttttttttttttttttttgttttatgaaaaatagtttgtattttaaatatgtaatttattttgtatatttagttatagtggtagtaattaggatatgtagagtggtaagtttatgaggagttagtaaattggatagttggtttttttagttggaattatgataggttttgaaaatgaagggtttttagtggagaatttttgtgtgggtgtatttgagagagggtaggagagttagggtgatttagaaagatagattgttggatttgtatatgtttttttaaagttagattgtagtattttgttagtaaattgttgtgtgttttattgttaaatttaggtttggaaggggagttgagtgtatttagtttaatttttggattggttgtgttattttgaatttttttatttggaattttttttgattttgttttaaatgaatatttgaatttggtttagtttttatagagtatggtttgtggttgttgttggtgttagggaagagtagaaatttgttgttgagagagaagatatttgagaagattgatgaatttttttttatttttgtttttgaggtttggtttttttattttatttaaatttttgaaatttttttttatttaattaaataagtgttaattggttattaggagaattagtttttttttattttagaaggaaatagggtttttttatgtatatgtttttaagaattatatgtaaattagttattaatgatgagttttttggtgattttggagtgttttatttttttaatattaaattaattgagggttttaatattttgttttgaaagaatatatttaaaaaggttgggtgtggtggtttatgtttgtaattttagtattttgggaggtttaggtggttggattatttgagggtaggagtttaagattagtttggttaaataatgaaattttgtttttgttaagaatataaaaaattagttggttatggtggtttaagtttgtagttttagttatttaggaggttgaggtatgagaattgtttgaatttgggaggttgagtttatagtgagttgtgattatgttattgtattttagtttgggtaataaagtaaaattttatttttaaataaataaataaataaataaataagaatatatttaaagataataattggttaggtgtggtggtttatgtttgtgattatagtattttgggaggttgaggtgggaggattgtttgaggtaaggagtttaagattaatttgggtaatatagtgagattttatttttataaaaatttaaaaattagttgggtatgatggtgtatgtttttagttttagttatttggggggttgagtttggaggattttttgagtttaggagattaaggttgtagtaggttatgattttgttattatattttagtttgagttatagagttagagtataatttttattttttaaaaaagttaataattgttaaatagttatttatgtatattaaggatgtttgttgtttaagaaatttttttaaattttttttatgaaattttttttagttgttgttttgtgagtgtgaattttttatttttgtaggatatataaatgtggagtatttgaattgaatgtttgggaaagtgtgatgggtaggtggaagaagaatagggatgaggatttattttttatttttatttttttagatttatttttttagtttgtaagtttgagaatatggtattaggaatatgtggtattttgtttatatatatagtgttggtaggttattagtagtttagttatttggattaggggtgatggatttttgtggatagaagttaaaaagtaaaattaggaggtaaaaatttttagggtggttataaagatattgtaatttgtttggaaattttaattaatattaaatgtgtatttagtgatatattaatagattggttttatttttttggatgtgtaataatattttatagaatgttttttttttttttttttttttttttttttttattttttttgaaatgaagttttgtttttgttgtttaggttggagtgtaatggtataattttagtttattgtaatttttattttttaggtttaagtgattgttttgttttatttttttgagtagttgggattataggtatgtgttattatgtttggttaattttgtatttttagtagagatggggtttttttatgttggttaggttggttttaaatttttgattttaggtgatttgtttattttggttttttaaagtgttggggttataggtgtgagttattgtgtttggttttagaatttttttatagatattattttattttatttttagagtattgtgaaaaggtatagtattaaataggtatttgattttattgaagaagatgtggtagtttagggagtttgtggatttgtttaagattgtttggtttttaggtagagttggggttagaatgaatgttttgttttatttattgatagaatatatataagaataggtttgatggtggttgattttttttttttttttttttttgagatagagttttgtttttgttatttaggttggagtgtagtggtgtgattttggtttattgtaatttttattttttgggtttaagtgatttttttgttttagttttttgagtagttgggtttataggtaagtgttgttatatttggttaattttgtatttttagtagagattgggtttttttatgttggttaggttggttttgaatttttgattttaggtgatttgtttattttggttttttaaagtgttgggattataggtatgagttatttgtgtttgggtgattgattttttattaattagatttataggtgttttgataaaaattagtttagttttggttggtatggtggtttatgtttgtaattttagtattttgggagtttaaggtgggtgggttatgaggttaagagattaagattattttggttaatatggtgaaattttgtttttattaaaaaatagaaaaaattagttgggtatggtggtgggtatttgtagttttagttatttgagaggttgaggtaggagaatggttgaatttgggaggtggagtttgtagtgagttaagattgtattattgtattttagtttgggtaatagagtaagattttattttaaaaaaaaaaaaaaaaaagtgtagtttttttggagtgtttttttgttatttttagggttaaatttttttttgtttatgaattattgttaaaattgggaattttaaatattattttttttttttaatttaaaagttatagtatgttttttagttagtatattagaatattatgtatgattttatgtgtataaaaagttttttggttgaatttagatgtgatttgagagggttaaatataggggtgtgtgttgggagagagagagaggtttttggatagaaaataaagtttgtttattatttaggatatggattaattattttaggttatggtgattaaagaaaattgatatgtaaataaatgaataatttttagaattaggatgtttgggtattggttttttggttggttaggtgaaattttatgttaggtttaataattaaattttttagagataatttttttttgttgtattagaatattgtattgaggttatgtttgaatatttaattgatgtgttgggaaaattttgttttataatgttaaagaaattaaattttttggggagttttttttttgattagtttatatttttgttttagaggagggttttttaattagaatgggtttgttgatttatttttatagatttttggtagaaaggaggtttttttttgttatttgtttttttgttttagagaattattataatggtgtaagtttattattttttttttttattatggttttgtttaggaagaaaaattttttgtattggttattaagtatttaattatttaagatgttattgataaagagttaatttgtgaattatgtgaatttgatatatttgaaatatatttaaataaaaagtatttagttttttaatgattttttagaagttagttttttaattttaattattatttttttggggatatgtggaaattttatagaagttgattggtgatatgttgagatgtgagatttgtattttttaagtaaagttgttatgtatttgattgattggttaggtgtattttggtatttgttatttgttggtggggtttgatagttggttttattattgttgggtatttagagttattatatttatagagatagaatgtaggttggtggttgttaggggttgggggaagggaggagtggggaatttgtttaatagagagttttagttttgtaagatgaaatgagttttagagattggttgtataataatgtgaatatttttaatattattgaattttatatttagaaatggttaagatggtaagttttatgttatatgtattttaatataattaaaaaagaaaaaaaaaaaaataattttaggttaggtatggtgatttatatttgtaattttagtattttgggaggttaaggtgggtagattatttgaggttaggagtttaagattagtttggttaatatggtgaaattttatttttattaaaaatataaaaattagtttggtttaattgtgtatgtttataattttagttaattgtgaggttgaggtaggggaattgttttaaattttggaggtggaggttgtaatgagttgagattatattattgtattttttagtttgggtgatagagtgagattttattttaaaataaaaaattattttagaaattgttagttttggtaatagttattattatatgttttattttgtatattttttgttaagaataaggaattgtttatgttgattaggaatttaagtaattaaaatataaaattttggttggtggtttttgtttgtaattttagtattttgggaggttaaggtgggtggattatttgaggttggaagtttaagattaggttggttaatatggtgaaattttatttttattaaaagtataaaaaattagttgggtatggtggtaggtatttgtaattttagttattagggaggttgaggtaggagaagtatttgaagttaagaggtggaggttgtagtgagttaagattgtattattgtattttagtttgggtgatatagtgaaattttatgtaaaaaaaaaatgaaatataaaattttatatttattattaattatatatagtattaaaataaaatttaaatattaaattttttttgattttatatttttttttagttattatttttttttttttttttggtttaaatttttgatttataatgttggttggaagtggtattattttggtgttagttttttattattttatttggtttgttttgtttttttttggtatattagttttttgaaggtagggtgtatgttttagaattttttgaagtttttttttttagtatattattatgtttattgtagtattttttatttttaatgtttttgatttggtgaaatattatattttgaatatatttttttatttttttatgataaatattgattgagttttagtgtaaggtgagtaagaaatggtatttgtttttaaggagttaaaaatttgaattttttttttttttttttttttttttttttttttttttttttttgagatagagttttattttgttatttgggttggagtgtagtggtatgattttagtttaatgtagtttttgttttttagatttagtgatttttatgttttagttttttgagtagttgggattataggtatgtattattatgtttggttaatttttgtatttttagtgaagatggtgttttattattttggttaggttggttttaaatttttgattttatgtgatttatttattttggttttttaaagtgttgagattataggtattgattttattttttatttttttatgtatttttattattttgaagaagggtttaaggtagttttgataagtaggattaggtttgtatgtaagtgattaaaggggtgttatgagtaaaaaaagtgtgaaggtataataagttaattattttataatgtagtttgtatgttttttaatggatatagtaggttttttgtaagaaaatagtaggagatttgtgtggaatgatgggttgaggtaatatagtggtattttttgaatgtttgaagaatgtgatttagagtttggtgggaagtagagagttgggttttaagaatatgaatttgataattttatggatttggaggagaagttaattggggatgaggagtagtaagaagtttgttatagatgtattgataagaagtaatgagagttggttgggtatagtggtttatgtttgtaattttagtattttgggaggttgaggtgggtaaattataaggttaggattttaagatgagtttggttaatatggtgaaatgttgtttttattaaaaatataaaaagttagttgggtgtggtggtgggtgtttataattttagttatttgggatgttgaggtagaagaattgtttgaatttggaaggtggaggttgtagtgagttgagattgtgttattgtattttagtttgggtgatagtgtgagattttgttttaaaaaaaaaaaaaaaaagtaatgtgataatgagagtttattttaagatggtagtaaaagatagtggaaaaaaggtattgggaaaaaaagttaatgtgttttgatgagtaaagttaattgagttaaggggagaagttaaaggtaattatgatgggttttttttattaatataaataggaaatgagtggttttgggaaagaaagtgatgaattattttttagatattgtattaattgtttattattgtggttgggtatggtagtttatgtttgtaattttagtattttgggaggttgaaataggtagattatttgaggttaggagtttgagattagtttggttaatatggtgaaattttgtttttattaaaaatataaaaattagtgtggtggtgtatgtttgtaattttagttatttaggaggttgagatatgataattgtttgaatttgggaggtagagattgtagtgagttgatatggtgttattgtattttagtttaggtaataagagtgaaattttattttaaaaaaaaagatttgtttgtaattagttagtatttttagttttgtgtttattttatatataaaaattttgttttttagagtataaattgaagggtatatttaaaattgatatgtaggttaggtatggtgatttatgtttgtaattttagtattttgggagattgaggtaggtggattatttgagattaggagtttgagattagtttggttaatgtggtgaaattttatttttattaaaaaatataataaattagttagttatagtggtgtgtatttatagttttagttatttgtgaggttgaggtaggagaattattagaatttgggaggtaggaggttgtagtgagttgagattatgttattgtattttagtttgggtgatagagtgagattttgttttaaaaataaagataaaattaaaataaaataaaattgagaagtaatagattgataagtgatatagttatattggttagtttttttagttaatatttattgttttttattattggagatttataatgtgtttttttttttttaaaaattttttttggaaatggtaatttttttttttttttttttttttttttttttttgagatagggttttattttattatttaggttggagtgtggtggtataatttttgtttattataatttttgttttttgggtttgagtaattatattttagttttttgagtagttgggataataggtatatgttattatttttggttaatttttagtagagatggggttttattatgttgtttaggttggttttgaatttttgattttaagtaatttgtttattttagttttttaaagtattgggattataggtgtgagttattatgtttggttttatagtgtattttaatattggttgagattagttttgtttattgatttttttttagtgtttatttggttatttttgtttatttttttataagaatttttatttttatttaattttgtgttttttggttttaaagattattttataataaatttttgtgattaaatttttgtgtttaaatttttgattaaataaataagtaatgaagagatgaatgaagtagaaaatgtgagttttatgttttatatttttatttttttgaggttaatatttttatgtatattttttaggatgtatttgtaattttatataaatgtatgtatttttttaatgaaaatatttaaatttttatagttaatagttgtagttttaatttggtaatattttttgtgtttttttatagt

SEQ ID NO: 746 - DNA, 13286 bp, Artificial Sequence
  chemically treated genomic DNA (Homo sapiens)
gttgtaaagaaatatagaagatattgttaagttagagttatagttgttaattatgaaaatttaaatatttttattaaaaaaatatatatgtttgtatgagattataaatatattttgaaaaatatatatgaaaatattaattttagaggagtgggaatgtgaggtatgaaatttatattttttgttttatttatttttttattgtttgtttgtttaattaagagtttaagtataagagtttaattatgaaaatttattataaaatagtttttaaaattaaaaaatataggattaaataaaaatgaaagtttttatggaaaaataagtaagaataattaagtaaatgttaagagaagattaatgagtaaggttagttttaattaatattaaaatatgttatgaggttaagtgtagtggtttatgtttgtaattttaatattttgggaggttgaggtgggtagattatttgaggttaggagtttgagattagtttgggtaatatggtgaaattttgtttttattaaaaattagttaggaatggtggtatgtgtttgttgttttagttatttaagaggttgaggtgtgattgtttaagtttaggaggtagaggttgtagtgagtagagattgtgttattgtgttttagtttgggtgatagagtgagattttgttttaaaaaaaaaaaaaaaaaaaaaaaaagagagaaattattatttttgaaaaaagtttttaaaagaaagaaaatatattatgaatttttaataataaaaaataatgggtattagttgaagagattgattagtgtaattgtgttatttattaatttgttgttttttagttttgttttgttttggttttgtttttgtttttgagataaggttttattttgttatttaggttggagtgtagtggtatgattttggtttattgtaattttttgttttttaggttttagtgatttttttgttttagttttatgagtagttgagattatgggtgtgtattattgtgattggttaatttgttgtattttttagtagggatggggttttattatgttggttaggttggttttaaatttttgattttgagtgatttatttgttttggttttttaaagtgttgggattataggtataagttattatgtttggtttatgtattagttttgaatgtgttttttaatttatgttttaaaaaatagaatttttgtatgtaaagtgagtataaggttgggggtgttggttgattataggtaaatttttttttttgagatggagttttatttttgttgtttaggttggagtgtaatggtgttatattagtttattgtaatttttgttttttaggtttaagtaattattatgttttagttttttgagtagttgggattataggtatatattattatattaatttttgtatttttagtagagatagggttttattgtgttggttaggttggttttgaatttttgattttaagtgatttgtttgttttggttttttaaagtgttgggattataggtatgagttattatgtttggttatagtaatagataattaatataatatttgaggggtaatttattatttttttttttaaaattatttattttttatttgtgttaatagaaaaagtttattatagttatttttgatttttttttttgatttagttaattttatttattaaggtatattggtttttttttttaatgttttttttttattgttttttgttgttattttgaagtaagtttttattattgtattattttttttttttttttttgagatggagttttgtattgttatttaggttggagtgtagtggtgtaattttggtttattgtaatttttattttttaggtttaagtgatttttttgttttagtattttgagtagttgggattataggtgtttgttattatgtttagttaattttttgtatttttagtagagatggtgttttattatgttggttaggtttgttttgaaattttgattttgtgatttgtttgttttggttttttaaagtgttgggattataggtgtgagttattgtgtttggttagtttttattattttttattagtgtatttgtaataggttttttattgttttttgtttttagttagttttttttttagatttatagagttgttagatttatgtttttaaaatttagttttttgttttttattaaattttaagttatattttttgagtatttaagggatgttattatgttgttttaatttattattttatatgaattttttgttgtttttttatagaaaatttgttatgtttattaagaaatatgtaaattgtattgtgaggtggttggtttgttatatttttatattttttttgtttatagtatttttttaattatttatatataaatttaattttgtttattagaattattttgaatttttttttaaaatgatagaggtgtataggagagtaagaagtaaagttaatgtttgtaattttagtattttgggaggttgaggtgggtggattatatgaggttaagagtttgaggttagtttggttaagatggtgaaatattatttttattaaaaatataaaagttagttaggtgtggtggtgtatgtttgtagttttagttatttgagaggttaagatatgagaattattgaatttgggaggtggaggttgtattaagttgagattgtgttattgtattttagtttaggtgatagagtgagattttgttttaaaaaaaaaaaaaaaagaaaaagaaaaagaaaaaaaaaaggaaatttagatttttagttttttgaaagtaagtattattttttatttattttgtattgaaatttaattaatatttgttataaggaagtgaggaaatgtgtttaaaatgtaatattttattaagttaaggatattaaagatggggggtgttgtagtaggtatggtagtatgttgagaaaagggattttaaggagttttgggatatatattttgtttttagggagttaatgtattaggaagaggtaggatagattaggtaaaatgataaggaattaatattaaagtggtattatttttaattaatattgtaaattaaaaatttggattaaggagaggagagagaatggtagttggagaaggatataggattaaggaaggtttggtgtttgggttttattttaatattatatgtaattaataatgagtatggaattttatattttattttttttttatatggagttttgttgtgttatttaggttggagtgtagtggtataattttggtttattgtaatttttgttttttgattttaagtgttttttttgttttagtttttttagtagttgggattataggtgtttattattatgtttagttaattttttgtatttttagtagagatggggttttattatgttgattagtttggttttgaatttttgattttaaatgatttatttgttttggttttttaaagtgttgggattataagtgagagttattagttagaattttgtattttaattatttagatttttgattaatataaataattttttatttttaatagaaaatatgtaggataaaatatatagtgataattattgttaaaattagtagtttttaaagtggttttttgttttgaaatgaaattttattttgttatttaggttggagagtgtagtggtgtgattttggtttattgtaatttttatttttagggtttgaggtgatttttttgttttagttttataattagttgggattataagtatgtataattaggttaggttaatttttgtatttttagtagagatggggttttattatgttggttaggttggttttgaatttttgattttaagtgatttgtttgttttagttttttaaagtgttgggattataggtgtgagttattgtgtttggtttgaagttgttttttttttttttttttttaattgtgttaaaatatatgtaatataaaatttattattttagttatttttaagtataaagtttagtagtgttaaggatatttatattattgtgtaattaatttttagaatttattttattttgtaaaattaaaattttttgttaaataaattttttatttttttttttttttagtttttggtaattattagtttatattttgtttttatggatgtgatgattttgggtatttagtagtggtgaaattaattattagattttattaataaatgataaatgttaggatatatttagttaattaattaggtgtatggtaattttgtttagaaaatatagattttatattttaatatattattaattaatttttgtagaatttttatatatttttagaaggatgataattaaagttagagaattgatttttggagagttattaaaaggttaggtgttttttgtttggatatattttagatatattagatttatatgatttatagattaattttttgttagtggtattttgaatagttaggtatttggtagttaatgtaaagagtttttttttttaagtagagttataataaggggaagaaatgatgaatttatattattgtaatagttttttgagataggagaataggtagtaaaaaaagattttttttttattagaggtttgtaaaaataagttaataaatttattttggttgagaagtttttttttaaaatagagatataaattggttaaaggaaagattttttaaaagatttaatttttttaatattgtagggtagagtttttttaatatattgattgaatgtttaaatatggttttagtataatgttttggtataataggaaaaaattgtttttaaagagtttaattgttgggtttggtatggaattttatttggttaattaaagaattagtatttagatattttgattttaagaattatttatttatttgtatgttaattttttttagttattataatttaaaatagttggtttatattttgggtggtgaataggttttgttttttgtttagagattttttttttttttttagtatatatttttgtatttggtttttttaggttatatttgaatttagttagaaagttttttgtatatatgggattgtgtatggtgttttaatgtattggttgggaaatatattatggtttttgaattaaaagaaaaaagtagtatttaaaatttttaattttgataatgatttatggataagaaaaagtttggttttagaaatggtagaaaaatattttaaaaagattatatttttttttttttttttttgagatggagttttgttttgttgtttaggttggagtgtagtggtgtaattttggtttattgtaagttttattttttgggtttagttatttttttgttttagttttttaagtagttgggattataggtgtttgttattatgtttagttaattttttttattttttagtagagatggggttttattatgttagttaggatggttttgattttttgattttgtgatttgtttgttttgggtttttaaagtgttgggattataggtatgagttattgtgttagttaagattagattggtttttattaaagtatttgtaaatttagttaataagaaattagttatttgggtgtgggtggtttatgtttgtaattttagtattttgagaggttaaggtgggtagattatttgaaattaggagtttgggattagtttggttaatatggagaaatttagtttttattaaaaatataaaattagttgggtgtggtagtgtttgtttgtaaatttagttatttagaaggttgaggtaggagaattgtttgaatttaggaggtggaggttgtggtgagttgagattatgttattgtattttaatttaggtgataagagtaaaattttgttttaaaaaaaaaaaaaaaaaaaaggttagttattattaagtttgtttttatgtatattttattaatggatagagtagaatatttattttagttttagttttgtttgaaagttaggtaattttagataaatttataaattttttgagttgttatattttttttagtagaattaggtatttatttggtgttgtatttttttatggtgttttgagggtgaaatgagatgatgtttgtgaaaggattttgaggttgggtgtagtggtttatgtttgtaattttagtattttgggaggttaaggtgggtagattatttgaggttgggagtttgagattagtttaattaatatggagaaattttgtttttattaaaaatataaaattagttgggtatggtggtatatgtttgtaattttagttatttgggaggatgaggtaggataattgtttgaatttgggaggtggaggttgtagtgagttgagattgtgttattatattttagtttgggtaataagagtaaaattttattttaaaaaaaataaagaaaaagaaaaagaaaaaaaaaaagaaagtattttgtaaggtattattatatatttaagaagatgaagttagtttattggtatattattggatatatatttagtgttggttggaatttttagataagttataatgtttttatggttattttgaagatttttgttttttaattttattttttgatttttgtttatagaaatttattatttttagtttagatagttgggttgttggtagtttgttaatattgtgtgtgtggataaaatgttatatatttttgatgttatatttttaagtttgtagattaggaggataagtttaggaggataagaatagaggataagtttttatttttattttttttttatttgtttattatatttttttaagtatttagtttaaatgttttatatttgtgtgttttgtagaagtaaaaaatttatgtttataaagtagtaattagaaggaattttatggaaaagatttaaaaagattttttaagtaataagtatttttgatgtgtataagtagttgtttgataattattagtttttttggggggtgggggttatattttagttttgtaatttaggttagagtgtagtggtaagattatggtttattgtagttttgattttttgggtttaagggattttttaaatttagttttttaagtagttgggattaaaggtatgtattattatgtttagttgatttttaaatttttgtagagatagggttttattgtgttgtttagattgattttgaattttttgttttaagtaatttttttattttggttttttaaagtgttgtgattataggtatgaattattatatttggttaattattatttttaaatgtatttttatttatttatttatttatttatttagagatagagttttgttttgttgtttaggttggaatgtagtggtatgattgtggtttattgtaaatttggttttttaggtttaagtaatttttatgttttagttttttgagtagttgggattataggtttgagttattatggttagttaattttttgtatttttaatagagataaggttttattatttggttaggttggttttgaatttttgtttttaagtgatttagttatttaggttttttaaagtgttgagattataggtgtgagttattatatttagtttttttaaatatatttttttaaaataaaatattaaggtttttaattaatttaatattaggaagataaaatattttaaaattattagagaatttattattaataattgatttgtatgtaatttttaagaatatgtatataaggaaattttgtttttttttaaaatgaggaaaagttaatttttttagtaattaattggtgtttatttagttggataggaaagagttttaagggtttgaatagggtaggaggattaagttttgaaggtaggggtgggagagagtttattagtttttttaagtgtttttttttttaatagtaagtttttgtttttttttaatattaataatagttatagattatgttttgtaggaattggattaaatttaaatatttatttgggatagggttagagagaattttgagtgaagggatttaagatgatatagttaatttagaagttaggttgaatgtatttaattttttttttaggtttgggtttgatagtagaatatataataatttattaataaaatgttgtagtttggttttgaggaaatatatataagtttagtaatttatttttttaggttattttaatttttttgtttttttttaagtatatttatataaagattttttattaaaagttttttatttttaagatttgttataattttagttaggaaggttaattatttagtttgttagttttttataaatttgttattttgtatattttagttattattattgtaattgggtatgtaaggtaagttatatatttaaaatataggttgttttttatagaataaaggaaaaaggaaaaagatattaattttatatatatatatgttagtagtatttattaataataggtttttaattgtatattgaattgaatattgtgttaaatagtgaaaaatattagtttataaaaggttatatatttttattttgtaggaaaatttagattttaagatatgagtatagaaatttaaaaattttgatatttataaataagttggatatagatttaagtttttatgaagataaatattttatttttagtaattgtaattattttgtattttaaatgtttttaatttgttatttttaatttttgttttgttttttattatttgataatatgtaattttaggtagtttttttaattttaggtataatgaaaagtagttttttttttaataaagaagttttaaaatttaaagattataaaagaatgatgtattttattaatatgatataaataatttttaatggttttgtattttaatttaggataattaatgatatatgttataattaaaggtttaaattataatagaatttaaatttgttaagaattaaatttattagttttatatgaatttaatatttagtttaagttttaagttttttatttgtaaatagtattgtttttgttttgatttattttaaggtattagaattaaaaatagtataaattgatttattttataaaaagggaaaaataggttttttttttaaaagaagtaaaggaaaatatgtttaagtaaaaatgtattaaagagtaaaattatataattattatgtagttttgattagtgatttttaggggtagtggggtaggtagaggtataaaggggatttttggggtaatggaattgttttgtgttatgtgtgtggtgttggttatatgattgtgtatttgttagaatttatagaggtatatttatagaggttaaattttattgtatgtaaattatattgttgtagtttaatttttttaaagtgttattgtatataaaataatgtgttagatattgaattatgaaatttaatgtttaagtatataatttttaaggtttttagatgtattattaaaaatttattattaaatattttgagtttagtttttagtattttatattttatttatatttatattttataaaatgatttaaagtattatttaaaattattatatgaattttgaattattatgtgtttaatatatatttatagaaaattttttttttatttttaaaagtgaatatattaatatttattaaatgttaattatatggttatgagttgaatttattattaaattttattttttttgaattataaatatattaagaaatgtaaattgtgattagatttatttatattttttagaatattatgaaatgtgttttaaatatgttaattgattttagaaatttttatgttttgagtaagatttaagtgttaataagtatttgatggtttttaaaataagaatgttttagaaatttatttaaaaaaatgtttgaatgtaaaatgtaattttatggtgtatattttaatgtttgttgatgaatagatttttatagttttttttttttagaatttatattaaaatatattttttttagaaaaaataggagttaaagatgttaattatgttttttttatagttatgttatatttgttttataatatttttagaaaagtttttttttttatatgtttattttttaaattataaatatgtttttttttattagatattgagttatgaaatttagagtaaaagtaaaattttttaatggaatgtttatgtaaatattagaaatataataaaataaggtaaagtttgttttttaaaatgttgtttattatattaaaatataattttgttttttaaatagtgagtaaaattaaattaattttatttttttaaatagaagtttatttaaagtttttttataaaaatgatatttatttgatttaatattgtttttttaataagaataatatgtagggtgttagagggtagttgttggatttttttttagtaaataaaggagattagttagagtttagtttggtttgtttaggaaaggaggaatgtagtttgttgatatggttaaggaatgttaattaatatattttaaaatttttattattttgtttgagatgtgtatatttttttaggtttttaaagtttaattagaaagtgtatttaattttattgttattttatttatagtggggaagtttattgaggaaaattatagggaaataaaatgttttttagttatttatattagtataattaatttagagtttatggtataaattaaataagttaatttgttagtgttttgaatgaagatatttaattaaagtatgtattttttaattttttagtagtttttaggatagttggttttggtgattgttttttggttttttattgtttttaatatgattggttttttattgtaggattttaaataaaatgagataattaaattatattttgagtgaaggggtgtttattttgtagataaatatattggttttgttttttttaaaatgtggatatgtgttttttttgtattagggggggttttttggtgtgtgttttgttgttatttgttgaggaaagtgagtgtattttttgtagtttaggttttgggtgttagttttgttttgtagttttagagtttgttgtagtttgggtggtttttttttggtttagtgtttgttgtttgttttttgttttgtaagttttaagaggtagttattttttgtagtttttgtgtttgtaattgttttttggtgggggagtgggtgtttaaaaagttagtagttggagaaattgaaaagattataagtgatttaatgataagtttttttttttttttaaagattgagaggagggtagaggggagtagtgtttgagtttatgtgattgagttagggagtttgatggttttaggaatgtttgatgttgtgtgtgatttttaagtgggagtatttttgaattgatttttggtttatttataaggatagtggtgtatagatggtgttttttgtagttttagttttagatttaagaggtttggagtagggtttgagaatatgtatttttaattaggttttgggggatgttgatattgatatagttagtttggggattatattttgaggattatgtttttagtttttgatttatataagtgttatttagaatagatgtttgattttaaggagttagtggtgaaattagagaggttttgggtttgttaaatttttagtagtaaatgtaattttgggttttggagtggtaaagttgtggattagaggtggagggagtgggtttttagtttttaagaggttattgggaaggttttttgtgttagattaaagattttaggtatttttttgaatttatttgaagtggtattggggagatttgtgtttttggttatggtgtttttttttgttggaggtatttgtttatttttttttttgggtgaaggttttttgtgttttttggtggtagttttagtttttttagtttaatggggtgttttttttatttattttagtaggagttttagggtgtgagattaggattatagttttaattggttttaaggtagttgttgttgatgaaaatgaaaaggaaagtagtatgtgatttataggttattgtgagaattttttagtgttatatttgtgtttaattaattattaaattatttatttaggtggtataagggatatggtttttgagggttgtgatttagatttttaatagaggaagatgagggggggtatttggagggaaagttttatagtattagttttagttgtttggtgtttagttaaaatagagagatgtaagtgtgttttgggttgataaagatgaggtttataggtaatgaagataggttttaaagatggagaagtatttgttttattagttaaataatagttgtgaaaagtttttattgttttattttaagtttaatttttattaaagttgagagttttggttttttttaggttgaaaggtagagtttttttgtttttgaggtagagaagttagtttggatgggaagagtgtgttgttggtaaataattgtagtagataatatgttaattttagtttttttgttttttgttttggggttttttaaagtatttagtttttatatgttttttttttttgttattttatggagaaaatgttaaatgatggtttaaaaaaattagttttatggttaggtatggtggtttatatttataattttagtattttgggaggttgaggtaggtggattatgaggttaggagtttgagattagtttgattaatatggtgaaattttgtttttattaaaaatataaaaattggttggatgtggtggtatatgttagtaattttagttatttaggaggttgaggtaggagaattgtttgaatatgggaggtggaggttgtagtgagttaagattgtgttattgtattttagtttgggtgatagagtgagattttgttttaaaaaaaaaaaaaaaaaaaaaaattagttttatttggtggtatatatttgttaataagatatttttggaaatggaaattgttatgaaggaattttaattataagttaataggtagaaaaagataggtgagggtgaagaaaatgtatttattaatattaatattatatttgatgttgtgttaagtatttgtatagtattttatttaatttttatattagtttagtgagatattgattttatttttttagtgaggaaattgaggtttatagagtttttgttagttatttgaagttatttagtgagaaaggaatttagta

SEQ ID NO: 747 - DNA, 6731 bp, Artificial Sequence
  chemically treated genomic DNA (Homo sapiens)
tataaattaagtgtataaagagagtttattaaaggaagttatggattattattaaatgtagggattatttatatatttgtatatgtggataatttttgtattaagaataatttagggttatttattaggttattttttgatgatattttttagtgtgttttttgggttaaattttatttattgaaattttttaatatggtattttaaagttttttatgatataatttgttttttttattttggattttttaaaagattttatttttttgtttttttagagaatgtgttatttttttttattgtgtattgtttatgtttttaaaagagtatatgtttattatatgattgtgaagtttttttttttgtttttgatatttagttgaaagtttttgaagggatttgattatattttatttttttttgtttttttagggatgttgtagttgggtatatagtagagtttataaaatgttgttgaatatagtgtattattgatataatataattttagatttttaattttgatttttgaaaggtaaatattgttataatgtattaattatatagaagatttaaataaatttaatttttttttaaataaagtaggtttgtttgttttttgttagggtatttatttttataaataaatttttggttttaggataatataaagagttagagtaggattttaagtagaattgtgtttttagttgatgtgttagttttttgagagttatgtggaaaaaaaaaaaaagaaaaaatttaaggtttaggttatttttattatttttgggaaattaggtttggagagttttttagggaaagaggtatgtttgttttgggtttttgtaattttattttataatttatttttttatttattgttttataaaattaaagggaaataggtataaattgtattgataaaagattagaattgaatttttaatggtaaaggtaagtgtatattataaatagtaaaatagttggtttggattatgttgttggttagttatttagttgagggatttgaatgatattataatttttgagagggtattgttagttagttggtgttatttagaatatataaaaattagagaaagaaaatatattttggtatatagattttttttgttatatatatatatatatatatatatatatatatatatatatataggtttgagttatatggaaaatttaaataataggaaaattgtttgttttttaggtattttttttttagagtggtggggtggggaggggatagtgataggtagtttagtagaagaataaagaaaaatgttttattttagttgggttttatagtttggtatagtttttgttttattgtaggagaaaaagtatgagatagtgttttaaagggattaatttaatgttgtttgtttttttataggttttaggaaatgagattatattttttatttggtaattgggataaggggttatttgagtgttgttttttaatttattttattttagttattttagggttaaaattgtagagtttgttggagagggttttattgttttttttttttttttttgttttaaataatgtatttgttttagaatttaaaattgtttttttattttttatatttttttaatattggtaaggtgtattagtagatgtttgtgtttttatgtttagtagaaagttaattagaaaatagatttttattttttatggtagtataagtattttaatgtttgtgaattttgttattaatatatatttttttaagggaaaaaaatgtttttgtgttttagttttaaaatgtaaaggtatgatgttatttgttattatgtttaaaaaagtttttatttaataattttgttagaagagggagagagagagaaggtaaatgtttttttagttgttttttgtttatagtgtttgtgttttgtagataaatgtgaggattttttttaaattttttttttgtttgttaaattttattgttattgttaaatttagagtagatagagtttgtgtaatggaataaagtttttaaaattgaaatgtgatattgtttttaatattttttatttttttggatttttttttgttttattatttttgttaattaatttatttttagattttgtattttagaagtaatgggaaaaattagtagttttttaatttaattatttaagtgttgtttttgtgattttttgaaggtaaatattttttattttttgaagttattggggaattttatttaaattgtgtattgtttgtttttgtttagaattgttttttattttaaaatttttattgttttggaattgagagttatttataaattgttgaatatgtaattttgtggaatttgaaaaatagtttggggagatggatgtatttgtatagatatttgtatgagtagaaattattgtaaggtatttatgttaaattttttatttttgtagggtttttgtggtgttattatagaagatttttttaaattttttttatggttaagggttatagagtatggatatgaatttggggatttttttttttttttgtaggtgtagatgttttatttttaagattatgtttttttgtatgtgtgtatgtgtttttgtgtgtatgtgtttttgtgtgtgtaatttattaggattttatttataaggtatgttatatatgaagggttgtattttagatgatattaaagtttttaaatatgatttttggagttaaggttttggaattttgtatttatgtttagagagagtgttaaagttagagtaaagtgtaatttgtttttttaaaaaagaattttttgataatttttgttgattttgtatatttgtataatttaaataaatatatattgtatatggaaagtagaaattttttaagagttgtttgtttaatttttttgtttagaagaggatttttatgggtaaagtttggatttggggttttgtgttataaaattttgattttatatttagtgttgtgaagtttttttaggtaaatttggttgttgttgttagtgtattgattttttgtttttgattgttggttgtagttttagtttttatttttagtaaaattatattttttaagatttgtgttttttttttaatttgtaagtgtttttaagttgttgttattggttttattgatttaattgtttgagggtttaatttataagatgtttttgttatttagtgtagtatttagttgttgtttttaaatattttattattatgattttttttagttaagtaagtggttttaggagttaaagatatatttttgttaggtatttgattttgttgtttttgagatgttaatatatgtaggttattttgtttttaaagaaatgatgttattgtgtatatatattatgtgatttagtagttggagtttttgtttttttatttaggggattataaaagaggttgtggagtgttatttttgtattaattataagttaagaaaattgtttttaaatgtattttttatgttgtgtatgttgaatattttagaagtggagtttttaataagttgttatttttttttgtatttgaagtaggaagtggtttgagggagttgtgtggttttttatatgtaatttagtgggtaaaggtgttttgtttagaggtagagtttattagttgattgtattttgatttttaaggtatttttaagtgagtgagttgggggaagggagtaagggagtggattggagtttgggttattatttgggttgttataataggtatataatggaaataggtggtttgattggggggaaaagattgatttaaattttagttgtgtaatttgtttattgttttaatggataaaaggtagtttatttaggtttataatagtatatttgtttgggtgtttaaatgtaattagatgtttttataaattttatttataaagtagtatatgtttttaagattttagttttttatttatattggttttataatatttattttgatttgttgtaaaagatttggaataaataaaaatgattatatttatagtgagtatttttttatgattgttgtttttaaattttatagggtatttttattgtggtttagatatttggaattaattaatattttatttatttaagattaaaaaaaaaagaatttttaaaatttgggtttgtgaatgatttttgagaaagtgttttttgattttttttttttttttttttatgtttttttgattttttttttttttttttattatattttttttttttttttattgattttttttgtgtttggtaaaataaaaggttaaggaaataatgaatatatgggattatttgttttatattttaaatttttaagtaagtttggtattgtttttatttgtgggaatataaaattttttggttttttgtgggtgtattggattgttttttatattaaaggaaaatgtattagaggttttgttttgttttagaattgtaagtattgagatttatttgataatataatttagtaaaaaaaaaaaaaaagaaaaagagaaatttatttaaaaaaaattttaaatttttaagttttagagatttatatgtattgttgtatttaaatgtgttatattagaattattaaaaatatagttttgatatttaatgaagtttgaaatttattaaggttataatttgagtaatttttttttttggattttataaaaattgaagaatttgaaggtatttatagttgtaggtgtttagtttttagtattgttatgaatgtaataaagaagggaggggtggagaaataggatttggtagaataatatattttttagaattggtttatttttgtagtgtgggggtatgttttgtaagattaattataggtttgtttttttgaaaaatgttatgaggtttaggtgggttggatttgttgaggtttttaatggaaatattgaataggaaaattttattaattttataattaaaaaaaaaaaaaaatgagaattggatgataatatgttttttttagttttagtgttttgggttatgtagggggtggaagatttttatgtggagattttgttgagaaaaatgtagtaaatgtttagttgagtttttatttttttttttattttatgtttattatttatgattatttgtaaatagagggtgttttttatttttaattgttttataattattaattgaatatttatattttgttaatgagagataggggttttggttttttttttttttttttagttgttgaggtgaaggtttgattataaaaaatggaaattattattagaatgatggggaaaattttgttattgatatagagttattaaattgagagtttatggagggtaaggagggtagttagaaaataaatgattgtttttttaaaagtgatggggttgaatggatttgttattattttgaggtttaaaaaaaatgttttttttataattatagtttttagtatgattttataatttttttaatagtgttttttatttaatattttgttagggattttttttatgatgttgaaagtagatgtatttgagagaagtgaagttatttattttgagaggttttttggaaaaagttatatttttgtgttataagtaataatatggaaaaatttaatgattattttagtatggtttttattatttagagtgaggatgaagatttgagttataggattgttgtttttggtaaggttgttgtttggtagtttattattgattaagttatgttaattaggggttttttggtatattttgttataaaatagatatagtgatatataagtttttttaagagatgaagttataatttttgtgattaaaaataaaataaaagatttttgttagtttgagtttagtgttttatatatagaagggatttttaatatgtgttgatttgatattggatttgaggttagggattttagaatataggagtggtttttatttgagttaattttattttttgatttttatatttttttttgtttttgttatttttttttatttgtggttgtgttaattgttgatatgttttaggtaaggaattagttttttttttttttttttttttttttttttttttatattgaggaaataaaataaaaataaaattttgtgatgatatatagtattgttaaaagttattttttggttatagtaaattatttttagttaaaaatagggaatgatgttttggttaaaaatattttgtttaataatgaatgtatatattatttatggatggttaatattgagagaatttaaattaataaaatttatttggttttaaatttgtattgagtataatttaatttttgataatttaaaagttttattagggttttagagtgatatgggattttattgtaataatagtattttttatttttgtagtaaatgtttttagatattttgttttaatttattgaaataggaatttataaagaaagggtttagggaggatttttttaaagatttatagtagttaggggaataaatataggttgttggatgttgagatatgttttatttataattttttttgggtttttatgtattttattggtttttgtgttgggtagttttgattaatgatagttgtggaattgtgggagttaatgtatttttgttttattttattttttttgtaaggattaaggaggaaatttgattttttttttgttttttgggtagg

SEQ ID NO: 748 - DNA, 6731 bp, Artificial Sequence
  chemically treated genomic DNA (Homo sapiens)
tttgtttaagaaatagagggagggttaggttttttttttgatttttgtaaggggagtggggtgggatagaagtgtattgatttttatgattttatgattgttattaattaggattatttagtatagaagttaatagagtatatgagaatttagagggagttgtggatggagtgtgttttggtatttaataatttgtgtttatttttttggttattgtggatttttggaggagttttttttgaattttttttttatgggtttttattttaatgaattgagataaaatatttagaaatgtttattatggaaatgaaagatgttattattatagtgggattttatattattttgagattttggtagaatttttgaattattaaaggttaaattgtgtttagtatagatttggggttaaataagttttgttaatttaaatttttttaatattggttatttatagatggtatatgtatttattattgagtagaatatttttaattaaaatattattttttatttttgattaaaaataatttattatggttaaaaaatggtttttgataatattatatattattatagggttttgtttttgttttgtttttttaatatgagagagagagagagagagagagagagagagagattgattttttatttggggtatattagtagttgatataattataaatagaagaaaataatagaaatagaaaaaaatatgagaattgaagaatgaaattggtttaaatagaaattatttttgtattttaaagtttttggttttaagtttaatattaaattaatatgtgttgagaattttttttgtgtatagggtattgggtttaaattggtaaaaattttttattttatttttagttataggaattatggttttattttttggagggatttatgtgttattgtatttattttatagtaaaatatattaagggatttttggttggtatgatttagttaatgatagattgttaaatggtagttttgttaaaagtagtagttttgtggtttaagtttttatttttattttaagtagtagaaattatgttaagatgattattaagtttttttatattgttatttgtggtataaagatgtggttttttttaagaagttttttaaggtgagtggttttattttttttagatgtatttatttttagtattatgggaagagtttttgatagggtgttaggtgaggggtgttattaaaagggttgtggagttatgttggaagttataattataagaagagtattttttttgaattttagagtagtggtaggtttatttaattttattatttttggagaaatagttatttattttttgattattttttttgttttttatggatttttaatttagtggttttatattagtggtaaaattttttttattattttaatgatgatttttattttttgtagttagatttttattttagtaattgaggaaaaaaaaaaaaaattaaaatttttgttttttgttaataaaatataaatatttagttaatggttgtaaagtagttgaagatgaaaagtgttttttatttgtaaatgattataaataatggatataaaatagaagaggaggtaaaagtttaattgaatatttattgtattttttttaataagatttttgtatggaaattttttattttttatatagtttaaaatattgggattggaagaagtatgttattatttagtttttatttttttttttttttggttgtaaaattagtggggtttttttgtttaatatttttattggaaattttaataaatttaatttatttggattttgtggtattttttaaaagaataaatttgtgattgattttgtagagtatatttttatattgtgggaatgggttagttttagaaagtatgttattttattgaattttatttttttattttttttttttttgttgtgtttatagtaatgttgaaggttaagtatttgtaattgtagatgtttttaagttttttagtttttgtgaaatttagggaaaaaaattatttaagttatagttttagtgaattttaaattttattagatgttaaaattatatttttaatagttttagtataatatatttaagtgtagtgatatatataagtttttggaatttaagaatttaagattttttttaaatagatttttttttttttttttttttttttttgttgagttatattgttagataaattttagtatttatagttttaggataagatagaatttttagtgtatttttttttagtgtagggaatagtttagtatatttatagagaattagagaattttatgtttttataaatgaaaataatattgaatttgtttaggagtttaaagtgtgaaataagtggttttatatgtttattatttttttggttttttattttgttaaatataaaagaaattaatagagagaaaggaaagatatgatagaaaaaaaagggaagaattagaaagatatgagaaaaaaagaaaaaaaaattagaaaatatttttttaaaaattatttataaatttaaattttaaaagtttttttttttttaattttagataaatggaatattaattgattttagatgtttgggttataatgaaaatgttttgtaaaatttgagggtaatagttataagaaaatatttattgtaggtgtaattatttttgtttgttttaggttttttatagtaggttagggtgggtattatgaggttgatgtgaatagaaaattgaagttttaaaaatatgtgttgttttgtgggtggggtttgtgaaagtatttagttatatttggatatttaggtaggtatgttattatgagtttgggtaaattgttttttgtttattgaaataatgaataaattgtatagttgggatttaagttaattttttttttttagttaagttatttatttttattgtatgtttattgtagtagtttagatagtgatttaagttttagtttatttttttattttttttttttgatttatttatttggaaatattttgagagttagagtataattagttggtgagttttgtttttgggtaggatatttttatttattgaattatatgtgaaagattatgtagtttttttaaattattttttgttttaagtatagaaaaaagtaataatttattaagagttttatttttgaagtgtttagtatatatagtatgaaaagtgtatttggaaataatttttttaatttgtaattaatgtagagataatgttttatagttttttttatgattttttaagtaaggagataaaaattttagttgttagattatatagtatgtatgtatagtgatgttatttttttgaaagtaaggtggtttgtatgtgttggtattttaggaatagtagaattaggtgtttgataagggtgtatttttaatttttggagttatttatttgattagggaaagttgtagtggtgaagtgtttgaaagtagtaattgaatgttgtattaagtggtagagatgttttatgaattgagtttttaggtaattgaattggtggagttagtgatagtagtttaaaagtgtttgtaaattgaaaaaaaaatataagttttgaaggatataattttgttgagaatggaaattagaattatggttagtaattggaaatgagaagttggtgtattgatagtagtagttagatttatttaaagggattttatgatattgaatataaaattagagttttataatatagaattttaagtttaaattttgtttatgaaagtttttttttaaatagaaaagttgggtaagtagtttttagaaagtttttgttttttatatatagtatgtatttgtttaaattatataaatatgtaaggttagtaagagttgttaaggagtttttttttggaagaataaattatattttattttaattttaatattttttttgggtataagtgtagagttttgggattttagttttaaagattatatttaaaagttttaatattatttaaaatataattttttatatatagtatgttttgtaaataaagttttgatgagttatatatatagagatatatatatatagagatatatatatatatgtaaaagaatatggttttaaaaataaaatatttgtatttgtaaaagaaaaaaaaaatttttaagtttatatttatgttttatagtttttagttatagagaggatttaaaggaattttttgtaatgatattatggaagttttgtagaagtggaggatttagtataagtattttgtaatagtttttatttatatagatatttgtgtaaatgtatttatttttttgagttattttttagattttatagaattgtatatttagtaatttataaataatttttggttttgaaataatgaaaattttaaagtgaagaatagttttaggtagaagtaaatagtatataatttaaatagaattttttaatgattttaaagagtaagaaatatttatttttaagaaattataaaagtagtatttaaataattgggttggaagattgttgattttttttattgtttttgaagtataaagtttgaaaatgaattggttagtaggaataatgaagtaaaaagaaatttagagagatgggagatgttgagagtaatgttatattttaattttgaggattttattttattgtgtaggttttatttgttttgaatttagtagtgatagtgagatttagtaaatagaagagggatttagagaaaatttttatatttatttataaaatatagatattgtagataggaaatagttgggggaatatttgtttttttttttttttttttttttggtaaagttattgagtaaggatttttttgggtatggtgataaataatattatatttttgtattttaaaattagagtatagaagtattttttttttttaaaagaatgtgtgttagtgatagggtttgtagatattaaaatatttatgttgttatagaaaataaggatttgttttttgattaattttttgttgggtatgaagatataaatgtttgttaatatattttattagtattaaaggaatatgggggatgggagagtaattttagattttagagtaaatgtattatttaaaataaaaaaagaaagaaaggatgataagattttttttagtaaattttataattttaattttgaagtgattggggtaaagtagattggaagatagtatttgggtgattttttgttttagttgttaagtgagaggtgtgattttattttttagaatttatggaggggtaggtagtattggattggtttttttagggtattgttttatatttttttttttgtgatgaggtaaagattatgttgagttgtaaaatttaattgaaatagaatatttttttttatttttttattaggttgtttgttattgttttttttttattttattattttgggagaagggtatttggggggtaaataatttttttgttgtttgaattttttatataatttaaatttgtgtgtgtgtgtgtgtgtgtgtgtgtgtgtgtgtgtgtgtatgatagagggagtttgtgtgttagagtgtgttttttttttttgatttttgtgtattttaaataatattagttggttagtaatatttttttgagggttatgatgttatttaaattttttaattgggtgattggttggtaatatggtttaagttagttgttttgttatttataatgtatatttgtttttgttattgagaatttagttttgattttttgttgatatagtttgtatttatttttttttggttttgtgaagtagtagataagaaagtgaattataaaataaggttgtaaaagtttagagtagatatatttttttttttagagagttttttaggtttggttttttaggagtggtggaaataatttggattttgaattttttttttttttttttttttatatgatttttaggggattgatatattaattgaaaatatagttttgtttgaaattttattttggttttttgtgttattttggggttagaaatttgtttgtagaagtgggtgttttaataaaaaataaataaatttgttttgtttggaagggggttgggtttgtttgagttttttgtgtggttaatatattgtagtaatgtttattttttagaaattaaagttagaaatttggaattatgttgtgttaatggtgtattatgtttagtaatattttgtgagttttattatgtgtttaattataatatttttaggaaaataaagaggaataagatatggttaagtttttttaggggtttttagttgaatgttagagataaagaggaaaattttatagttatatgatgggtatgtgtttttttaaaaatatgaatagtgtataatgagagggagtgatatattttttgggaagataggggagtaaaattttttggaaaatttaaaatgagggaggtagattgtgttatgagaggttttggggtattatgttgggaaattttagtgggtgggatttgatttaaagagtatattaagaggtattattaagaggtggtttagtaggtggttttggattatttttaatgtagggattatttatatgtgtagatgtgtgagtaatttttgtatttaataataatttgtggttttttttaataagttttttttgtatatttgatttgtg

SEQ ID NO: 749 - DNA, 5559 bp, Artificial Sequence
  chemically treated genomic DNA (Homo sapiens)
tttagttagttgtagttatttttttttgtgttggatttggaggaagggggtggagaatgagaggatgttttttgttttttgttttgtttttttgttttatgtgatattggtatgtgggagtaatattgttggatgttttttttttattaaatggttaaaataattattataatttttaaggtttttttatggttgttttttagtgaaattttataatatgtttatggggtgggaattgatgttttattttatagttgattttattgaagtttatgaggaagaaattggtttaaattatagttttttttgattatagaatagaaaaagttagttaaaattttaggattattttttttaggtgatgggaggattttagaagttttgtggatatttgaaattgggtataaaattaggtgttttatgttagtgggtattttttaggtagagggattatattttttttgagagtttaaaagtgtgttgaataagtttattttttatagatggggagattgagtttggggatagggagtggtttgtttagaaaagatttagaaattaaatttagtttagtgggttgatatttatttaaatttttagtttggggagattgatgtatttaagagaagaatttagaaatgaaattttgtttttttatgttaaaaaataaaattttttagagtgtttataatttttttttttatttttttttttttgttttaaataaataatggtgaatgagtatttagttagggatgtgtttgattaaataattatggattaatagttatgtttggagaaggaatttgtggttgttttagttattgggtattttgtttggtttagtttatgtaattttttaatattttatgaagtaaggttttgttaattttattttattgaaaatgaattaagatttagagagataaagttgttgtttaatgagttttttttttgttttttagatttatggtgttaattttttttttgatgatttaatgattttgagtttggtaaaggttttattttttagtttgtttaggtttagtgttttaggaatgtgatttttgttgtagtagttgttggagggggtagaggggatgggttggaggttgagtaaatagagtagtagaaaaggtagttttttttttttagtgttttttttttttgtttttgttttttttttttttttttaggtattagagtggagattttagggagattagagtttagtttgttaggtattgagttagaagttttgttatggtatttttgagatttttttttatattggttttgttggtatgggttgttttggttgattaaggtataggggagtgttggtggttatttgggttaatgtagggagggtgagggtggtttgggtttggtggtattgattgatattttttttttatagagttatgtaagggttgttgtattgagggttttaatgtggataagaagtgttagtgtgatgagttttgtttttattattagagttgttgtatagattatatggttgagtgtaagttttaaggtgtgtttagagtttaggtgggtgggttggggtgttttttgttgttggagatttattattatttattttttgtagtgatttgtggggatgtgtttattatgttggaggatgagtatatggtttatgatgatggtgaggagaaaaataatgttattgtttatgaataggtggggggtttttttttgatttttgatttttaggtttagtttaaagggaattttgagtagatatttgttttgaaatttgaggaagaggtttttgtgtttgaggtgggtgtttttaagtttgaggggatagatttaaggtttgagattttttatttagggagattttagtttttagtagaggaggagttgtgtagtgggaagttttttgatgtttttattgattttaagaatggttttttttttgttttttgaggtgaatttagggtaggtattggggatgtgggtttgttttaggagtgtttttgtttttatattattttttttattttagggtagtattgttatgaattggatgaaaaggtagtgaggtttgggtattttaagtttatttgagatgtttggggtattgagggttttattgatgttgtttttatttgtattaattgttaggggaagatttatttttttaaggtgttaggggttgtgggttagggtagaaagtatttagggagggtttgagagttattgtttttagggatagggtggatagggaagttggatttagggttttgtaggatttggtgggagttttgtgagtatagggtagttttaagattttaggttttgggtagtgaatttggatttgggaatggttgttttagggtaagggattttgtttttgtgtttagttagtggtttttatatttttttttattttttttattttttagggtagttagtattggtgttttgaggatggtgttttggattttgattatttttgaaatatttttgatggttttgatggtattttggataatgtggatgtagttttggttttttttgtttatagttatagtggttgggagtgggtttatttttttaagggtatttagggggtggtgggagattgagtaggtagtggagtagttttggattttttttatattttattggggataggttttagtatgtgtttatttttgatttttattttatgttgggagattttaattttaatagtttttgggatttttagttttgttttggtttagtttttttaatgtttattattttgttttttagggaaatagtattgggagtattagttttagtattagtttagttaggaggagtgtgaaggtagttttttgttggttgtgtttgaatattttgttatgatgtagtgggatagttgggaggatatttttgagttttttttttggggtagaatttttggtatggagagagggtaagttttgttttttttttaaaagggttgaaattttttggtattggtagagttaggttggttggagggggttgtggttgtggagttattgattaaagtttgtttgtttaggttagattttgtttttgttgattttttggggaaagtttagttttatttggattttatattttggattttgtttagtatagttgagagtatagttagtagagggaggggttgtggttgaggagtttagggggtttgggggggtggggttgagatattagtgatatggtggagggaaagtatagggggaagggaattggattgagagttaaaggtttggttttgttatttgttgttgtgtgtttttgggtaaggtgtagtagatgaattttaatggttttgttggaaggggtaagatttggatttttaagattttttatttattttttttttgttatagttggtattagatagttttagtttattagttgggattggtatggtgtgttagggtaagtggatgtagttatggttggttgtatttatattttaggtatggtattttgtttttttttggttaagaaataaaggtttaggtattgtaattgtaaaggttattgtttataatgaggttatagttgtggttgtaattagaatttttgttggttattttgtgttatgtggttgtttttgttttttagtgaggagagtaatttgggagttaataattatgatgattataggatggattggtttgtgtttgttatttgtgaatttatttagagtgttttttttttttttggaggtaggagttgttgttatttttgaagttggtttagtttgggttttttttgttgtttttggtgtataagggttgaatgtagtttgtaagtagtgattatagaaagttaggttagaagtttttagttgtattatggatgtttatttttttttttgggagagattttagattttttaagggaagagtgggtagggttaggttgggttttatgtattttttgttttttttttttttagataagtattattgagttaatttttgtatatggtgagtggatattgtggattttttttatttatgttttattgtttagtattggttgggttgtttagtttttggttatttgtaggagttagagtttatatggttgggttttttgtagttttttttttttattttttttttttagtttaataaaggttttttagttttgagtttaaaattattgttttgattggggtagatatatttttgtttgggtaaaggagaggaagttggattgttagaatgggttggtgagggggatagagaagggatagagaagggttttgttgtgtttaatttatgttgggtttaggatttttttgtgtttaggatttttttgtgaattgaagtttggggttggggaaggttttttgagagttatttttttttttgagttaagtagtttttagtaatttattagtagttaagtagatatttgaatttttttgatgatgataaagttattaggttagtttttgtgggtgaggtttgttttgttttttggagttgattagggttttggaggagagagaaggggtaagagttggtggggttttggtttagtttttttgtttattttgatttgaaattttagtagttttgatttttgagtatttggggaattagttattgtgtttttttaaatttatttttagggtgagttttttttgaggtttttgtttagggtttaggatggggagtagtaagattaggagagatagtgaagggtagaaattgaaaggaaatttaaaagtatatattttttgtggaaaagtggtttaggagtttaggagtttgaagttgtagtgagttattattgtattattgtattttaatttggggaatagagtgagattttatttttaaaaatagaataaaataaaaaagggggggaatttttgtttgggtatggtggtttatgtttgtaattttagtattttgggaagttaaggtgggaggattgttggaattttgaagtttgagattagtttaggtaatatagtaagatattatttttataaaaataaataagttagttgggtaatttatgggtggtgtgtgtttgtagttttagttatttaggaggttgaggtgggaggattgtttgagtttgggaggttgaggttgtagtgagtagaaattatattattgtattttagtttgggtaatagagtgagaaaaagaaaatttaggttaggtatggtggtttatgtttgtagttttagtattttgggaaattaaggtgtgtggattatgaggttaggagtttgagattagtttggttaatatggtgaaattttgtttttattaaaaatataaaaaattagttgggtgtggtggtaggtgtttgtaattttagttattttggaggaagaggtaggaggtggagttgtttgaatttgggaggtggaggttgtagtgagttaagattatgttattgtattttagtttgggtgataaagtaagattttattttgaaaaaaaaagaaaaaagaaaaaaatttttaaaatttaagaaaaagtggtttagaatatatttaaggaa

SEQ ID NO: 750 - DNA, 5559 bp, Artificial Sequence
  chemically treated genomic DNA (Homo sapiens)
ttttttggatatattttgagttatttttttttaaattttgaaaatttttttttttttttttttttttttaagatggagttttgttttgttatttaggttggagtgtagtggtgtgattttggtttattgtaatttttattttttgagtttaagtaattttattttttgtttttttttttggagtagttggggttataggtgtttgttattatatttggttaattttttgtatttttagtagagatggggttttattatgttggttaggttggttttgaatttttaattttatgatttatgtgttttggttttttaaagtgttgggattataggtatgaattattgtgtttggtttaaatttttttttttttattttgttgtttaggttggagtatagtggtgtgatttttgtttattgtagttttaattttttaagtttaagtaatttttttattttagttttttaaatagttgggattataggtatatattatttataagttgtttagttaatttatttatttttgtagagatggtgttttgttatattgtttaggttggttttaaattttgggattttagtaatttttttattttggttttttaaagtgttggaattataggtatgagttattatgtttagataaaaatttttttttttttttattttgttttgtttttagagatagagttttattttattttttaggttggagtgtagtggtataataatagtttattgtagttttaaatttttgggtttttgggttatttttttataagaagtgtgtgtttttgaatttttttttagtttttgttttttattattttttttggttttgttgttttttattttagattttagatagagattttaagaaaggtttattttaggggtgggtttggggaagtatagtgattggttttttaagtgtttaggagttagagttattaggattttagattaggatggataaaaaagttgagttagaattttattaatttttgtttttttttttttttttaagattttagttaattttaaggggtaaagtaagttttatttatggaggttggtttggtaattttgttattattagaggagtttaagtgtttgtttagttgttggtgggttgttgggggttgtttagtttaagaggaagggtagtttttaggaggttttttttagttttaaattttggtttatagagaggttttgagtatagagaggttttgagtttaatatgggttggatatggtgaggtttttttttgttttttttttgttttttttattaatttattttgatagtttagtttttttttttttatttagatagggatgtgtttattttagttagaataataattttaaatttggggttaagggatttttattgggttgggggaaggagatgggaggagggagttatagagggtttggttatgtgggttttgatttttatagatggttaggagttgggtagtttagttagtattgagtgatggagtgtgggtagggagggtttatagtgtttatttgttgtgtgtgaagattgatttggtagtatttgtttggaagagaggaaagtagaggatgtgtgaggtttagtttggttttgtttattttttttttgagaagtttagggttttttttagaagggaaagtgaatatttatgatgtagttaaggatttttggtttggttttttgtggttattatttgtaggttgtgtttagtttttgtgtattagggatagtaaggaaaatttaagttagattagttttaggggtggtagtggtttttatttttagagaagaagaagatattttggatgggtttataggtggtaggtataagttagtttattttgtagttattatagttgttggtttttaagttgttttttttattggagaataaggatagttatgtggtgtgggatggttggtgggagttttggttgtggttatggttgtggttttgttgtgaatggtagtttttgtggttgtgatgtttaaatttttgttttttggttaaggaggggtggggtgttatgtttgagatgtagatgtggttagttatggttgtgtttatttgttttggtatattgtgttagttttggttaatgaattggggttgtttggtattagttgtggtagggaaggggtgaatgagaggttttgggggtttgaattttgttttttttagtggggttattagagtttatttgttgtattttgtttaaagatatatagtagtgaatggtagagttaggtttttgatttttagtttaatttttttttttttgtgttttttttttattatattattggtgttttgattttatttttttaggttttttaaattttttagttatagtttttttttttgttggttgtgtttttagttgtgttaggtaaagtttaaggtgtggggtttaggtagagttgagttttttttaaaaggttaatagaagtaaagtttggtttgagtaaatagattttgattgatagttttataattatagttttttttagttggtttggttttattaatattaaggggttttagtttttttgagggagaagtaagatttgttttttttttatattagaggttttgttttagaagagaagtttgaagatgtttttttagttgttttgttgtattatggtaaagtgtttaaatatagttgatagggagttgtttttatattttttttgattgggttggtgttggaattggtatttttagtattgtttttttgaggagtggggtggtgggtattaggagggttgggttagggtaagattggagattttagaggttgttgaagttaggattttttagtatgaggtgggggttaggggtgggtatatgttgaggtttgtttttagtgaagtgtgaaaggaatttaagattgttttattgtttgtttagttttttattattttttgagtatttttgaagaagtagatttgtttttggttattgtagttatgggtagggagggttaaggttgtatttatgttgtttgggatgttattgaagttgttagagatattttgggggtaattagggtttaggatattatttttaaagtgttagtattgattattttaagaggtggggaaagtgaaaaggggtatggaggttgttggttgggtatagaggtagagttttttgttttaaggtagttgtttttaggtttaggtttattgtttaggatttggagttttggggttgttttgtgtttatagagtttttattaggttttgtagggttttgggtttagtttttttgtttattttgtttttgggagtaatagtttttaaattttttttagatgttttttattttggtttatagtttttggtattttgaagaggtaggtttttttttgatagttgatgtgggtgaaggtggtattgatggggtttttgatgttttagatattttggatgagtttggggtatttaggttttattgtttttttgtttagtttatagtagtattgttttagagtggaggagatggtgtgagagtagggatgtttttggggtagatttgtatttttagtatttgttttggatttattttggaaggtaaagagggaattgtttttgaggttggtgaaggtgttgaagggttttttattgtatagttttttttttgttgggggttgaggtttttttggatgaagggttttaggttttgagtttatttttttaggtttagaggtgtttattttaggtgtaggggttttttttttaggttttagaataggtgtttgtttaggattttttttggattgggtttggaggttagaggttagggaggggttttttatttgtttatggatagtggtattgtttttttttttgttattgttatagattgtgtatttattttttggtatagtgaatatatttttgtgagttattgtagagagtggatggtagtgagtttttagtagtagggggtattttagtttatttatttgggttttgaatatattttggggtttgtatttagttgtatagtttgtgtagtagttttggtagtaagagtagagtttgttatattggtattttttgtttatgttgaagtttttagtgtagtggtttttgtatgattttatgaggaaggagtgttagttggtgttattaagtttagattatttttgttttttttatattgatttagatggttattaatatttttttgtattttggttagttagagtaatttatgttagtagggttagtatgagaaggggttttaggggtgttatggtagggtttttagtttagtgtttggtaagttgggttttggtttttttgaagtttttgttttgatgtttgaggaagggagggagaggtagagatagggaaggagggtattggagaagaggaattgttttttttgttgttttgtttgtttaatttttagtttattttttttgttttttttagtggttgttgtagtaaaggttatatttttggaatattgggtttgggtgagttgggagataagatttttgttaagtttagaattattaggttattggaaggggaattagtattgtggatttggagggtagaaagaaggtttattgggtaatagttttatttttttgagttttagtttatttttagtaaaataggattaataaagttttgttttatggggtgttgggagattatatgaattggattagataaaatgtttagtagttggagtagttataaattttttttttaaatatagttattgatttatgattgtttgattagatatatttttggttgggtgtttatttgttattatttatttagggtaggaaaaagggagtgggaggagagattgtaagtattttggggaattttattttttagtataaaagaataaagttttatttttgggttttttttttgggtgtattaatttttttaggttggaaatttgggtaaatattaatttattggattggatttaatttttgagttttttttgagtaggttattttttgtttttaggtttagtttttttatttgtaaagagtgggtttgtttaatatatttttagatttttgagagaaatatgatttttttatttggaaaatgtttattggtatgaaatatttgattttgtgtttaattttaggtgtttatagaatttttgaaatttttttattatttgaaaaaagtgattttgagattttagttgattttttttgttttgtaattagaggggattgtgatttgggttaattttttttttatgggttttagtggagttagttgtggaatggaatattaatttttattttataggtatgttgtgaggttttgttaagaaatagttataaaagggttttaagagttatgatgattgttttaattatttagtagggagggggtatttagtggtgttgtttttatgtattgatgttatgtggggtggggaggtggggtggagaatggagagtgtttttttattttttattttttttttttaagtttagtgtagggggaggtggttgtgattgattgag

SEQ ID NO: 751 - DNA, 3476 bp, Artificial Sequence
  chemically treated genomic DNA (Homo sapiens)
ggatatttagtttttttgttttgtgatgttttatattattttgggtttttgtaaagaatttttataagtaagaaggtttttataagatatattttttggattttagattttttagttttgaaaattgtaagaaataaatgttgtttttataaattatatagttttaggtattttgttattagtaatagaaaagagattaggatagatattatagttagattgtattttatatattgtgattggttttttagagaagtaatgtataaaaagaggaataattggttgggtatggtggtttatatttgtaattttagtattttgggaggttaaggtaggtgaattatgaggttaggagtttaagattagtttggttaatatggtgaaattttatttttattaaaaatataaaaattagttaggtgtggtggtgtgtgtttgtagttttagtttttttggaggttgaggtagaggaattatttgaatttaggaggtagatattgtagtgagttgtgattgtgttattgtattttagtttgaataatagagttagattttgttttaaaaaaaaaaaaagaggaataatttttaaaatagtaaataaatttttgtagataggaaatataatggtagatatttgagttaggagagggggaatggggaattattatttaatggatatagttttagtttaggaagataaataagttttgggaataaatagtagtaatggttatataatgtgaaggtatttaatgttattgaatttaaagttggttaaaatggtatttgttatgtgaggtatattttattatttaaaaaattataggtgattgtgtttttaaaagagttattagtttaatttttaatagaaattaatggattttgtttatttttaataaagttaaaatatgtatatgaaaaggttatggggtaaaggtagaggtaattatttttttttttgaaaggtattttttataatgaatgtttttatgtaataaaaaatgaaatgataaaagtttagaatgtttgtgggttttgttttttaaatttttaattatataaattaatatttatattatatagattaagatatatattttttttttatttataatatttttttattttttgtattttaaattttgatattaaatgttattaaattttttaaattttaagagaatgatttggttattaaggaagatataatttatagtttagagagtgggtgaataaaagtagtttttaatgtttttaattgttttttttttgttaattaaatgtttttgtaaataatttatttttgttggttttgggtaagatgtgggagaaggaagaatttttgaatggaggagtttggaaaggatgtttgataaaatgtttgtgttttttggagatgtagttagtttttttttttttagggtttggttttgatgatagtattttgtgttttggggatgtttttttttattagatttttttaaagtttagttgtatttatttttaagtgggagataaggtttttgtttgtgggttttgtgtttgtttatttggttttatgtttgttgtggattaaataggagttattggattagagtatatttgatttttggttttgtggattaaaaattttaggattaaggaatagtaaggttaggttgaaatagtttatatagggtttgtggtaaatgtttttttaggagttatttgtttagtgtagtaagttgtgtatttagttgatttgagtgttttagggagatgtttgattttattttgtgttgttttggggtattagttttgttttttttaggtttattgaggtaggtatgtttagttttgggatagttagtaaataagttatgaattgtgttagggattagagtatttagagtttttgtttagttgttggtatagttaattgtagtgtagttaggtggtggggtggtgttggttgaatttagatttgaggttttagaagtagagttaggtgaagttgggttagaattgtgatttttgtaattttgagtggtatttgtggagtgtgtttgtgtagttatgattgtagtaggaaagtgttgttggttaggtttagttgtggttggatagggattggaagagaggatgtggttgagtaggtgtgtattagttttggtaatgagagtgtttattttgaattttgttggttttgaggtggggaagttggggagggtagttgaggattttgtggaggtgtgtgattggttgagtgggtaggttagtttttgagttgggtggatataggtattgtagttaggttgtgttgtgttgatttagggtttggtttggttagatagggaagtttagtttttgtatgttagatagtggtatttttgttggtgttattgtaaatattttttgattgttatagttagtgtgtggtgtaggtgttatgtttttggttttgttatgtttggagttttggaagttggttgtagggtgttggttttttgtgtgtggttatatgattttgtttttgatttaggggagtagtttggggtgttggtagtataggtttaagtgaatgaaggagggagtagtgtgtgtttttttttttagttttttttgggaaagtattttagaaaggttttatttaaggagaggttggggtggtgtggtggtttatttttgtaattttagtattttgggaggttgaggtgggtggattatttgaggttagtagtttgagattagtttggttaatatggtgaaattttgtttttattgaaaatataaaattagatgggtgaggtggtgtatgtttgtagttttagttatttaagaggttgaggaagaatggtttgaatttgggaggtagaggttgttgtgagttgatattgtgttgttgaattttagtttgggttatagagtaagattttattttaaaaaataaataaataaataaataaataaataaataaataaataggagagattggaaaatttattttagtttttggtgtttgttagttaggaagatgtgtgaaggttttttaatttttggggatttttttgtttttatttgggaattttattttattattagtgaggttttgtttgggtatgaaatttggattttttgtgattggtataaaatttggattaattgttttttggttttttagttgttgttttaagttttttatatataaggtagttttatattgtttttataatttaaattgttattgtataaattgttttagtttttatagttttggataggttgttttttattttggtgagtttatttagtatttttatgtgttttgtttttttttaggtatatttttggttttttttatagtttttgggtaaatgtttgggagaataatttaaatatttttattttattatggtggttttaattttttagggggtagtaagatggttttttaggattggtttaattagatttttatttttgttttttttttagg

SEQ ID NO: 752 - DNA, 3476 bp, Artificial Sequence
  chemically treated genomic DNA (Homo sapiens)
tttaggaagggaataaaaatgaggatttgattagattaattttaaaaagttattttattgttttttgaaaaattagggttattatggtagaataaaaatatttaaattatttttttaagtatttatttaaggattgtggaagaggttaaggatgtgtttggagaaaaatagggtatgtggaggtattggatggatttattaaaatgaaaagtagtttgtttagagttgtaggagttgaaatagtttatgtgatgataatttaggttatgagaatggtatgaaattattttgtgtgtgagaagtttaaggtaataattaggaaattgggaaatggttgatttaggttttgtattaattgtaaaaaatttaggttttgtgtttaggtaaaattttattaatgataaggtgggatttttaagtagggataaagagatttttaagagttaggaggtttttatatatttttttgattaataaatattaaaagttgagataagttttttaattttttttatttatttatttatttatttatttatttatttatttattttttgagatggagttttgttttgtggtttaggttggagtttaatggtgtgatattggtttatagtaatttttgttttttgggtttaagttatttttttttagttttttgaatagttggaattataggtgtgtgttgttttgtttgtttaattttgtatttttagtagagatggggttttattatgttggttaggttggttttgaattattgattttaggtgatttgtttattttagttttttaaagtgttgggattataggagtgagttattgtgttgttttaatttttttttaaatgaaatttttttgaaatgtttttttaggaaaaattgggaaggagagtatgtattgtttttttttttatttatttgggtttgtgttgttgatattttaaattgtttttttaaattagggatggggttatatggttgtatgtgggaagttagtgttttgtagttagtttttagggttttaggtgtggtagggttggggatatgatgtttgtgttatatattggttgtagtggttagaggatgtttgtggtgatgttagtaggagtattgttgtttggtgtgtggggattgagtttttttgtttggttgggttaggttttgagttggtgtggtgtggtttggttgtggtatttgtgtttatttggtttggaggttggtttgtttgtttaattagttatgtgtttttgtggggtttttaattgttttttttggtttttttattttaaggttagtagagtttggggtagatgtttttgttgttagggttggtgtatatttatttgattgtgtttttttttttagtttttgtttggttatagttgggtttggttggtggtgtttttttgttgtggttgtagttgtgtaggtgtattttatggatgttgtttaaggttgtggaggttgtggttttggtttagttttgtttgattttgtttttaaaattttgggtttgggtttggttggtattgttttgttgtttggttgtgttgtgattggttgtgttggtagttgggtggggattttgggtgttttgatttttggtgtggtttgtggtttgtttattgattgttttagagttgggtgtgtttgttttagtggatttggaggaagtagagttggtgttttggggtggtgtagagtagggttgggtgtttttttggagtgtttgagttaattaagtatatgatttattgtattgggtgagtggtttttgaaaagatgtttattgtaagttttgtgtggattgttttagtttaattttgttattttttagttttggaatttttggtttgtagagttgagagttaagtgtattttagtttagtggtttttgtttagtttatagtaaatgtggggttgggtggatgaatgtagagtttgtgggtagaagttttattttttatttaagggtgggtgtagttgggttttagaagaatttggtaaggaaaggtatttttaaaatatgagatgttattgttaagattagattttaggagggaggagattggttgtgtttttagagagtgtgggtgttttgttaagtattttttttagatttttttatttagggattttttttttttttatgttttatttaaaattaatagaaatgagttatttatagaaatatttggttgataggagaaaagtagttgagaatattagaagttgtttttatttgtttattttttaggttatggattatattttttttggtaattaagttgtttttttgagatttaagaaatttaatgatatttaatgttaggatttaagatatagagaatggagaaatgttgtagatagaggaaaaatatgtattttaatttgtataatgtagatattaatttatgtaattaaggatttaaggaataaaatttataaatattttaaatttttgttattttattttttattatataaaaatatttattgtagaaaatattttttggggaaaaaaataattatttttgtttttattttataatttttttgtatgtatattttgattttgttaaaaatgaataaagtttattgatttttattgaagattaaattgataatttttttagaagtataattatttatagttttttaagtggtaaaatatattttatatagtaagtattattttaattaattttgagtttagtagtattaagtatttttatattgtgtaattattattattgtttatttttagagtttgtttatttttttaaattgaaattgtatttattgaataatagttttttatttttttttttttagtttaggtatttattattatattttttgtttgtaggaatttgtttattattttggagattatttttttttttttttttttgagatggagtttggttttgttgtttaggttggagtgtagtggtgtaattgtagtttattgtaatgtttgttttttgggtttaagtgatttttttgttttagtttttagaggagttgggattataggtgtgtattattatgtttggttaatttttgtatttttagtagagatggggttttattatattgattagattggttttgaatttttgattttgtgatttgtttgttttggttttttagagtgttggaattataggtgtgagttattgtgtttggttgattatttttttttttatgtattgtttttttggagaattagttataatgtgtagaatataatttaattgtgatatttgttttagttttttttttgttgttaataatagaatatttggaattgtgtaatttatgagaataatatttattttttatagtttttgaggttgggaagtttgaggtttaggaagtgtattttgtgagggtttttttgtttgtggggattttttgtagaggtttaaggtggtgtagggtattatagggtgagagggttgagtgttt

SEQ ID NO: 753 - DNA, 11429 bp, Artificial Sequence
  chemically treated genomic DNA (Homo sapiens)
gttagattttttagaaagggtttaggaaggttggagtgagatggggtgggagtggtatttatttttaggaaagtttagtttagaggtaagttttgtgttgtggggtgtggggagttatgtgttttatttttttttggttgtttgtgggaaaaggtttagaggtttgggttgagaagaggagtgaaagtatagagttgatttttttttatttatttgggaaatgggtttgggttaattgttgattttgtgtttgttggtgtagttttttgtggagattttggtggggagggaggttgaatatttggatgatatttttgtgagagtggttttggagtggtggttggggagggagaggtgtgtttgtgtgtatgttgggttgggagggaggtgattttttggggtttgggttttgttttttttgttttttattgtagtttttttttttgttttttagtttttattttgtagtttttagtttttgagtttttttggtttttgattagttgagtttttttattggtggttttgttttgttagagggtatttttgattttttggaaaatgttattattttttattgtttttggagtgtttttaggtttttgtttgttttttgattttgattttgttaatgaagaattgggttaggattgttgtggagtggatgttgattttttgatttggtttgtaggttgggagttttttttgtgaggttggtatggttgtttttattgggttttgtgttttttgtggattttgttttgggttgggtttggtttgtgggtggttttgggattgggggattaggagggagagtagatgtgggttgtggatggtgtggattgatagttggtgagagggtgttggggttgggggaaagggagggagggggtttattggagtaattttttagaaaaatagttaatgtgtggtaggagtgattttaagaggggaaaaaaagtttagttattatgttgaatgagaggatttgtaaagtattttttaaaagggtttggttttttttgtgtttgtttaaaatattaatattgtgtagtaaaagaggttgtgtgtgttggttttttttttttttattttaggttagagatgttatgggagggaggtataaaattttagtagagagaaatagagaaagtagtgtgtgtgtatgtgtgtgtgtgtgagagagagagggagaggagtgagagggagagggagagggagagagagaaagggagggaagtagagagttaagtttaagggaatgagtgagagaggtagagataggggaagaggtgtgtgagagaaggaataatagttttttggagtaggtgtgttgtgaattggtttttattttattttattttttttttttttttattttttaaagagaagtaggggatagaagtaatggttgaggtagaagataagttgaggtgttggtgattttgggtgtttgagtggatgattggggttgttgtgtttagaggtttgtttttttgttttttaatgtatataattttatattttagttaatgaagatgagaggtagtgtgaataaagttatttagaaagtttttgaggaagtgtaaataaaagagaaagtatgaatggagtgtttgagagataagtgtgttttgtattgtttttatttttagttgggttagtaattgtttggttttgtttttttttatttatttattggtgatttttttttttttatttttttttttttttttttttttattttttttttttatttttttttaaggtaaggtaaggattttgattttgggatttagttatggtttttttgttttttttttaaaatatttattttttttttattgttaagtggtgtttggtaatattagatatttattttatttatttttatttaaggaaaaattttagttttttttttatttttagttgttttgttattttttttagttttttgtttgttttttatttggtttgttgggagttagagtttagtaaaatttgtttagatatatggataagaattttagtgttataaggtatatagtttgtttttttgtttttagggttgttagtgttttttggaagttttgaagtttttgtagtgtagtgagtttatgtatttttttgttaagttttagtttttgggatttggggaggttgtttggtttttttttttttttttgtatgtttgttggggtttttttttttttaggttttgttgtttttttggtttttttttttagtttatatatgaagatgtatttgtaaagggttttggtggttttggttttgttgaattttgttatggttagtttttttttgtttatttgtattattttggattttggttatattaagaagaagagggtggaagttattaggggatagattttgagtaagtttaggtttattagtttttttgagttaatggtgatgatttatgttttttattaggttttggttttttataatagtatttgggagttgttggaggagatgtatggggagagggaggaaggttgtatttaggaaaatattgagttggaatattatgttaaagaaatttataaatttgatatgatttaggggttggtggagtatagtaagtttaaatttttgttggggtgtttgttttggagggtttgaattggagttgggagttttgtagaggggggtttagtgttggttatatagtagggtgttttaggatttattagtattaaggtttaggatgtgtgatgtttttttgttggggttggggaggtgggtggggaaggagatagagttattttgttaagagttggtgtttttgggaggttaggagttttggagttgagtggtttgttgaatttatattatatttttgattgattttaatttggaattatattgtgttgtttagggaaatatatgtatttttgtatatgtgattgtattagtaattgtaagtatttgggtgttataaaggggaaggttggttttgttaggagtttttatggtttttagtgtggagattttattttttttttgttttttataatttattgtgatatgtttttgttttagtttttttagtttttgggaagaagaatatttgttttaaattaatgtttgttaagttttttgaagtttaggtaggagatagttttttgttgtttgggttttttggtttattttatttatgtgatttatgagatttatgtgagttgtgtgtgtggaaggaagagggtatgtatgaatgtttttagggttgtgtattttagggtgatatgtagttttgtgtagtagatagatttatgtgtttaaaatgggtgttttttaggttggtgggtatggggagagtgggttttggttgtggatgtgtagaggaggttggtgttttttgtgtttgtgtgttatgggagagtgggtggaggggtggtagtgggtgtatggtgggggggggggatatgtttgggagtttgttgttttaggaggttttgtttgtatggaggagttgggtggtttttgggtgagatgtttgtgtgtgttggtatatgtgtggaagttatatgtgtttattgaaggggattttaaaaattttaatataagagagagaaatttggtagatgttgagaaattgatagtttaggaaagaggaatgtgagttatttgtgggttgtagattttgggagtagttttgtttgttttttttattagtaggtgtttttgttgttttgattattttagtttaggtttatttgggaggtgggtagtttttggagtggggtggagggtatgggatggagttggtaggtaggggagggtggttagtagagtatatagtaaggggtgaaaggaatttggttggagagaaggaataggagtgggtattgatgggtggattagttttggttggaggtgtaaaggttttgtttatggttttatgttaggtagaggagtttgtggttattggtgaggggtttttgttttagttttttgtggttgtttggagtgtttttttttaggatgtggttgttatgtggggtggaggttggaggttgatgtagagttattattttttgtttagggtttttgggtggggttggtttagagatttatagtttttagaggtatttagtagtttgatggttaaggttttaattttttgggaatttattaatgtgggagatagtgattataagtattagaggaaggttgaaatttgaggttggtaggagaggtgtgaggagagtttagggtaagagggtaggatttagatttttatggtttgggttagtaggaggagtttaagggaggaagtattttgagttattaggatttttttattttggaattttgagttgagaatgaatgagttatgtggaggtaaggttatgtaggtgtaagtggatattgattttgtgtagatttaaagtataaatagtagatgtttttgggaaaagtttgggtagggttttatagatgttgggtagtttttaggttgtagtattaagattttataattgtaatagatgggtggatgtggggttatggagtaatggtttggtttggggtaatttagtatagtgagtaggatgttgtttaggatgttggggaggagttaatgtgtgatgttatgaggtttataggtataaattggaagtaggtagattttgtagttgttggaggtgatttggaggttgagtagatggatttgggtttgttttgtagttggttgggtgttgagtttattttagagaggtagatatataaggtatattaattataaagaaggtagtgggtaggtgttgagtaggagtagagagttattattaggggtttgtaaggtggtggggtggggtgggggaaggaagtttgtttttaatttatgagggtagataggggtgatattaggtttgtggtggggtatagtagggttttaatgttagagtttttgttgggaggttatgagattatgttttgttttatatttttttatttttggttatttttttgatttagtgaatatgtatttaaaggaaagtgatagtaggagttagggtaaggagatagaggtttttggagaggaaaatgaaagaggaaatattttttagtagtgtaggagaaagggtattaaggtgagagtagagaggaaggtttttttttaaataattttttttttttgttttatagataaggaaattgagatttggattgtttaagtaatttgtttaaaaagagtagggattttaatttagatattttgtgtgtaggatgtatgtagttaagtatttatttatatgtaaaatatatgttgtaagtgttatttttaattttttttaatttttagggtttagtagaattttgatttataatataaatgaattatgtgttggattaagtaggagaggttagagttattattttagtaatttaggtggtagattgtataatgataattggatttgtttttttttagttttgtatttttttttttttttttttgtttgggagatttatattgttataaatgttttttttaatttaatgaaggagttttttttatttaatgaagagttttaagtaggttaagtaattgtagttatgtaaaagtgatttttttgagttttagtttttttagttgtaaagttagagatgatttttaaatttttttttagttgaaagaattttataattttatttgggatgaattagtagagtttttattggggagtatgggtaagattttgtaattttttttttaattttttaggattttattgttgggagggagtagagagtttttttgattttatgtgatgggaaaggatatagtttttttatttttgttgttattttttttataaaggtattattaatgtaggtgttattttattttttggtttgtaattatttgtttttgtttggagatttgttgtttttagttaagggtagtgttaagataattagtaaatttagagttttttagtaaagagaaaattttatattttagtttttgttttttagttgttaagtgtagattttgtttattttgagaattattttgaaaattatttgttttaagggttaatgttttttgtatagtagaggttagtatttttttaagtgtggtttagaggaagttggaggtaaatgtagattttttggttttatttatttttatagaattagaattttgagggggtggagttttggggaatttgtatttttgataagttttttatggatttttaagtatattgaagtttaagagttagtgaattagggtgaaattttttttagagggatggtaaatataagtgtttatagagatttggtaggaaatgtaaatgatttggaagaaaagttatggtgttatgataaattgtattaggatatttggttttggggttaagaagaaagtagggtgtgtgagatagggagagggaggggatttggagtttatgtgtttagttaaagtagtagttagttttagtttttgttgggttttgtattgaggattgtgggtttagtttgattagttttttttgtgttttagaaaagtagaaaatttggatttttttgtgaagtgttttaatttttaatatgggtttaaaatgtttatgggtttttaatttaaaatttttaaaggtgttttattagtgaaataatatgtttaatttatttaatggttaattaatagaaagtttatattattaaagtagtggttttttaaatttttagaatatttagaagttatggtgttttttgtaatatattataatttgtggtttttaattttggttgtatgttagaattatttggagattttgaaaaaaatatgttgtggattttatttattttagtgtagttagaattgttggggaatgggtttaggaattatttgtttttaaagttttttaggtgattttaatgtgtagttagggtagagaagtatagttatattgataaatatagtttttttattagaattagtagaaatgatatatataagtaaaggtatatttagttatttaggtgtttgaatatattttaaaaggtagttaattaaatatggttagttattttttggtttttttatgtatattgtatatgaatattttttgtttatgttttgttttgttaaataaaatagagaaaatggtatttattaatatatattttttttgtgtaatggaaaaagttgtttaagatttaatttgtaaaggtgggattttttagtttagtttttaataatattagtgttttgtgaggtatggtttaagaattataaatttgtttgtagtgggttattgtttgaggtataggttgatattttaggtttatttagtggaattttgttatattttgttgatgaaattatttttattagatgattttttagattttttttagtttgaagagtttttgttttaataaatgaggtatgtttagaagatttgggtttaaattttatttttattattttttagttatgtgattttgggaaagatatttaattttttgaggtttagtttttttatttgttaagtgataaattttatatgtttttattttttttaggggttgttagaaggttatatgaagtaataaaaatttgataaaataaggtggtgttattatattttgtttatttatgtatatgatgatttattttatagattatttaaaatattattatttagtgaatttgattgttaagaagattgtatgtatattttttttgattttttaggtaatttttttttttaattaattttaattttaatttttttgatagagttttattttgttatttagtttggagtgtattggtgtaattttggtttattgtagtttttgttttttgggtttaagtgatttttatgttttagttttttgagtagttggggttataggtgtttattattatatttagttaatttttgtatttggagtagagatggggttttgttatgttggttaggttggttttgaatttttgatttttagtgatttatttgttttggttttttaaagtgttgggattataggtatgagttattgtttttggtttttaaaatttttaattttaaataatagggataggttttttttatgttgtttaggttgattttgaatttttgggtttaagtaatttttttgttttagttttttgagtagttgaaataatagatatgtgttattatgtttagttaatttttgtattttttatagagatggggttttattatgttggttaggttggttttaaatatttgagtttaagtaatttatttattttagttttttaaggtgttggttgggattataggtgtgagttattatgtttggttgttaatttttttttttttttttttttttttttttttttttgagatggagttttattttgttgtttaggttggagtgtagtgatataattttagtttattgtaattttgattttttaggtttaagtgatttttttgttttagttttttgaatagttaggattataagtatgtattattatgtttggttaatttttgtatttttagtagagatggggttttattttgttgtttaggtgttaatttttttttaattattagtaattgtgttttaagttttgtttgttagtgttaagttgtttgtgttagttaatttttgagtgattttggttaagattttttagatagttatttttttttttgaagagggttgtgttatatgatttttgatgttttttttaattatgggaaatttatatattttagtaatagaaaaatgattttttttattttttttttgaaattttaaaattttttttaggatgtgtttattttggggagtagattatgattgataggttggaagaaattaaagaggatggttattagggtgttttgagaatttttttagtttataattttttttattttttggttttttattgttttgatttattttgattgttttattagtaagtgttattttttatttttttttttttttttttgagatggagttttattttgttgtttaggttggagtgtaatggtattattttagtttattgtaatttttgttttttgggtttaagtgatttttttgttttaatttttttagtagttgggattataggtatgtattattaggtttggttaatttttatatttttagtagagatagggttttattatgttggttaggttggttttaaatttttgatgttgtgatttgtttattttggttttttgaagtgttgggattataggtgtgagttattgtgtttggttttattttttttttttttatagtaaggtgtatgttgtattgatttattttttattttttttgtagttattggagttgtgttatttatttattttattaatttatttatttatttgaaatagagtttttttttgttgtttaggttggagtgtagtggtataattttggtttattgtaatttggattttttgagtttaagtgatttttttagtaggtgttattgtaattgaagttatattaataatagtttttttaaaatttagttttgttgtttttgatagggttgttaatgtaagtagtttatttatatttagagtattataaatttgtaaatttatatattatttaattattattgatttttttttttggttttatttgaaatggtttagggaattgttggtagtatttgtttttttaaagttaattattaattagggttttattagatagtatttatatatttgtttttttaatatttgttttattaattttttaagaattagtgttaggtttattagatggtaatttttagaaatatttatttatttttttttgaagattagtagtgtatttgtttgtttttaggtttttgattttttttgttttgtttgtgatttttttaataattttttggggtgattataagtttattttagttatgtttattatgtgtggaatttgggtttatgagtttgaattttaattttgggttattgttattatttgtgtagaaagtttttttttgggtgttaatattgtttagattttgaggttgttaagtgtataggagtagagaaaagataggttttttttttttttttggtttagaggggtgggaaagagtatttgttgtttatattttgtggatagggatgaagaggttagtaggtgatagtgtttggtatagtatgtgttgttaaggaaagagaaaggagttaatggtgatatattagtttggttagaggaagtatttgtgtttttgttaggtttatgatgtgggttttttgttatataagttttgttttattgggtttaaaatataaggttgagatgttattgtattgtttaaatatttttagtgattttttattgttaatgggttaaaatttaattttttagtttgataggtggattttaatttattattttgtttttttttatttggtttttatttgttgttttgggttttttttatttatttgtatttttttttttttttgtttttgtttttagtagttattttatgtaatattttttttttttttatttttaaatttttttaatttttattttttttgtgaagtgttttttgttattttttttttttgattttttgtagtaatttttggatttttttgaaaattattggttttttgttgttttttttatttgtgtttttgtattgtgatattttttggggtattttgttttattatttttttttagttttgttatttgggtttatgtattaatatttttttttagatattaatttataagtttgaggttgtatttttttgaattttgaaattagattttggttttgattttgagtagtaggatataaataatttttatatgtttagtgttttaataatggaatattaggtataaatgggttttaatttttttgaaggtaggggttgtgtttatttatgttttgttttttaaggttagtattatgtttggtatatagtagttgtttaatatatttttgataaatgaatgaatgtttagatgaataaatatatgaataaattaattagttgtaagatatgtaaattattaggtgttgatatttttttagaattagtatttttttaaaaagtaggaaaaatgggttggaaaatttattagaattgagatgttaaggtagtgggaggagggggtaattagatttgattggttagtttagtgttatgttgtggagttttgaggttatattgttttttgtttaggattgtgtgtgattttagggttattaagaattttttttgtatttttattttgtggtttgaggttttaagtttttagggaggtggtaggtgggatggtggttatttggtgtttgtttgttggtagtatattgtttttgtatgttttgtttatgttgtgttttttgttttgttttattttttaga

SEQ ID NO: 754 - DNA, 11429 bp, Artificial Sequence
  chemically treated genomic DNA (Homo sapiens)
tttaggagataaagtagagtagagggtatagtatgagtgagatatgtaggaatagtgtgttgttaatggataggtattaagtggttattgttttgtttgttatttttttagaggtttgaggttttagattgtaaggtggagatatgaggaagatttttggtggttttagaattatatatagttttgagtaaggagtagtgtggttttagagttttataatatggtattagattggttagttaaatttaattgttttttttttttattgttttgatattttagttttggtaagttttttaatttgttttttttattttttgagaaaatattgattttagaaagatattagtatttagtagtttatatattttatagttagttgatttatttgtgtgtttgtttatttgggtatttatttatttattaaagatgtattgagtagttattatatgttaagtatagtgttaattttgggaagtaaaatatgagtagatataatttttgtttttaaggggattaaaatttatttatgtttggtgttttattattggaatgttaagtatgtaagagttatttatattttgttgtttaaggttaaggttaaggtttgattttaaaatttaaaaaagtgtagttttaggtttatgggttaatatttaagggggggtattaatatatgggtttaaataataggattagagagaaataataggatagagtgttttggaagatgttataatgtaggagtataggtgaggggagtgataggaaattagtggtttttagagaagtttaggagttgttgtaggaaattaaaggagggaaatggtaaggagtattttatggaaggggtgaaaattgagaggatttgaggatggggaggaaagaaatgttatatggagtgattgttggaagtaaaggtagggaggggaggaaatgtaaatgagtaagaggggtttgaaatagtaggtgggagttaggtgagaaagggtaagatgatagattggggtttatttgttagattaaaaggttaaattttaatttattaatagtagggagttattgaaagtgtttgagtagtgtagtgatattttaattttgtgttttagatttaataaagtagggtttatatagtaaagagtttatattatgagtttggtagaaatatagatgttttttttgattaagttggtgtgttattattggtttttttttttttttttgatagtatgtgttatgttagatgttgttatttgttggtttttttatttttgtttataagatgtgggtagtgaatgtttttttttatttttttgagttagagaaagagaaagagtttgttttttttttgtttttgtatatttgatagttttaaggtttgagtagtattaatatttagagaaaaattttttgtataaatggtaataatagtttgaagttgaaatttaagtttatagatttagattttatatataatggatatggttggaatgagtttataattattttgaggggttgttgaggaagttatagataaggtaggaaggattagaggtttggaaataagtaaatgtgttattgatttttaggaaaggatgagtgagtgtttttggaaattgttatttggtgggtttgatgttggtttttagaaaattaatggaatagatgttaggaaaataaatgtgtgaatgttgtttaatgaagttttgattaataattggttttgaaagaatagatattgttaatgattttttaaattattttagatagaattaaggagagaaattagtgatagttaagtaatgtgtaagtttataagtttgtaatattttgaatgtggataagttatttgtattggtaattttattaaggataatagagttgggttttgaaggagttgttattgatatggttttagttataatagtatttgttgggaggattatttgagtttgggaggtttagattgtagtgagttaggattgtgttattgtattttagtttgggtaatagagggagattttgttttaagtaaataaataaattaataaagtaaataaataatatagttttagtgattataagaggaataaagggtaagttagtgtaatatgtattttgttgtaaaaagaagggagatggggttgggtatggtggtttatgtttgtaattttagtattttgggaagttgaggtgggtagattatgatattaggagtttgagattagtttgattaatatggtgaaattttgtttttattaaaaatatgaaaattagttaggtttggtggtgtgtgtttgtaattttagttattgaggaggttgaggtaggagaattgtttgaatttaggaggtagaggttgtaatgagttgaggtggtgttattgtattttaatttgggtaatagagtgagattttattttagaaaaaaaagaagggagatggaaaatggtatttgttggtgagatagttagagtgggttaaggtagtgggaagttaggagatggggaaagttatgagttaagagagtttttaggatattttagtggttgttttttttggttttttttagtttattaattataatttgttttttaggatgaatatattttggggagaattttaaggttttaagaaagaggtgggaaaggttatttttttattattgggatatatagattttttatgattagaagggatattaggagttatgtggtgtaattttttttagaggaagaaatggttgtttagagggttttggttagagttatttagaagttagttgatataagtaatttgatattagtaagtaaagtttaggatataattgttagtgattaaaaaagaattggtatttgggtaataaggtgaaattttgtttttattaaaaatataaaaattagttaggtatgatggtgtatgtttgtaattttagttatttaggaggttgaggtaggagagttatttgaatttgggaggttgaggttgtagtgagttgagattgtgttattgtattttagtttgggtaatagagtgagattttattttaaaaaaaaaaaaaaaaagaagaagaagaagaagaattggtagttaggtatggtggtttatgtttgtaattttagttagtattttgggaggttgaggtgggtggattgtttgagtttaggtgtttgagattagtttggttaatatggtgaaattttatttttataaaaaatatgaaaattagttgggtatggtagtatatgtttgttattttagttatttgggaggttgaggtgggaggattgtttgagtttaggagtttaagattagtttggataatatagggaggatttatttttattatttaaaattaaaaattttaaaggttgagaatagtggtttatgtttgtaattttagtattttgggaggttgaggtaggtggattattggaggttaggagtttgagattagtttggttaatatggtaaaattttatttttattttaaatataaaaattagttgggtgtggtggtgggtatttgtaattttagttatttgggaggttgaggtatgagaattatttgaatttagaaggtagaagttatagtgagttgagattgtattagtgtattttaggttgggtgatagagtgagattttgttaaaaaaattaaaattaaaattaattaaaaaaaagaattgtttgggagattaaagaaaatgtatatataatttttttgataattaaatttattgaataatgatgttttaagtaatttgtggaatgaattattgtatatataaataagtaaaatgtaatagtattattttgttttgttgagtttttattattttatgtgattttttaataatttttgagaagaatgaaaatatgtaaaatttattatttgataaatgagaaaattgagttttaaaaagttaaatgttttttttaaggttatataattagaaggtggtggaggtggggtttgaatttaggttttttgaatatattttatttattgaagtagagattttttaagttgggagggatttgggagattatttggtgaagatggttttattaataaaatatggtaagattttattaaatgggtttagagtgttaatttatgttttagataatgatttattgtaaatgagtttgtggtttttaagttatgttttatagaatattagtattattgagagttggattagggggttttatttttataaattaaattttgagtaattttttttattgtatagaaaaaatatatattggtgaatgttattttttttattttgtttaatggggtaaaatataagtaaagaatatttatgtatagtatgtatggaaaaattaggaaatagttgattatgtttagttaattgttttttaaaatgtgtttagatatttgggtggttaggtgtgtttttgtttgtatatattatttttgttggttttagtgaagggattatatttattagtgtggttgtatttttttattttggttgtatattagaattatttggaaagttttaaaaataaatgatttttggatttattttttagtagttttgattatattggagtgagtggggtttatggtatattttttttaagatttttagatgattttaatgtgtagttagggttgagaattatagattataatgtgttgtaaagggtattatggtttttagatgttttggaagtttgagaaattattgttttaatggtgtgagttttttattgattaattgttaaatgaattagatatgttgttttgttgatggaatatttttaaaaattttgagttagaagtttataaatattttaagtttatgttaaaaattggaatattttatagaaagatttagattttttgtttttttgggatatgggaagaattaattaagttggatttatagtttttaatgtaaaatttagtaagaattgaggttggttgttgttttggttgggtatgtgggttttaggttttttttttttttttgttttatatattttattttttttttgattttaagattaagtgttttggtgtagtttattatgatgttgtggttttttttttagattatttgtattttttgttgggtttttgtaggtatttgtgtttgttatttttttaagaaaagttttgttttagtttattgatttttaagttttaatgtgtttaagaatttataaggagtttgttgaaaatataggttttttaagattttatttttttaagattttgattttataagggtgggtgggattagggaatttatatttatttttagttttttttggattatatttggagaagtgttgatttttattgtgtagagggtattggtttttggagtaaatgatttttagaataatttttagaataaataaaatttatatttagtagttagagaataaagattaaaatatagagttttttttttgttgagaaattttgggtttgttggttgttttagtgttgtttttggttgaaaataataagtttttgaatagagatagataattataagttagaagataaaatgatatttatattggtgatatttttgtaagagggatgataatggaagtaaaaaagttgtgtttttttttattatatggggttagagaaattttttatttttttttgatagtaaaattttggagaattagaaaaaggattatagagttttgtttatattttttaatagaggttttgttgatttattttagatggaattataaaatttttttagttgaaaaggagtttggaaattatttttaattttatagttggggaaattgaggtttagagaggttatttttatgtagttgtggttgtttaatttgtttgagattttttattaaataaagaaaatttttttattaaattagggagaatatttgtggtagtatgaattttttgggtaaaaaaaaaaaaaaaaaaatgtagagttaaggaagaataaatttagttattattgtgtaatttgttatttgggttattaagataataattttgattttttttgtttggtttaatatatgatttatttatgttataaattaaagttttattgaattttaaaggttaaaggaggttaaaggtaatatttataatgtgtattttatatataaatgagtgtttaattatatgtgttttgtatatagaatgtttaggttagggtttttgttttttttggataaattatttaagtaatttaggttttagtttttttatttgtaaaatagggagaaaaggttatttaggaaaaggtttttttttttgtttttattttggtgtttttttttttgtattattaaaaagtatttttttttttatttttttttttagggatttttatttttttgttttggtttttattgttatttttttttgaatgtatgtttattgggttagggaagtggttagaagtgaggaaatatggaatagaatgtgattttatgattttttagtagaggttttggtattgagattttgttgtgttttattatagatttggtgttatttttgtttgtttttatgagttaaagataggttttttttttttattttgttttgttgttttgtaagtttttgatgatggttttttgtttttgtttagtatttgtttattgttttttttatagttagtgtgttttgtgtgtttgtttttttggggtgggtttagtatttgattagttgtagggtgggtttaggtttgtttgtttagtttttaagttatttttaatagttgtagagtttgtttgtttttggtttgtatttgtgagttttatagtattgtatgttggtttttttttagtattttgaatagtattttgtttattgtgttgggttgttttaggttagattattgttttataattttatatttatttatttgttgtagttgtaaggttttggtattgtagtttggaagttgtttagtatttatggggttttgtttgggttttttttaaggatatttgttatttgtgttttgagtttgtataaaattagtgtttatttgtatttgtatggttttgtttttatgtggtttatttatttttagtttaggattttgggatgggggggttttggtgatttagaatgtttttttttttggattttttttgttgatttagattatgaaggtttgagttttgtttttttgttttggattttttttatattttttttgttggttttagattttgatttttttttgatgtttgtggttattattttttgtgttggtgggtttttagggagttggagttttggttattgagttgttaggtgtttttgggaattgtgggtttttgagttagttttatttagagattttgggtagggagtagtagttttgtattggtttttagtttttgttttatatggtagttatattttgaagaaaggtgttttaggtagttataggaagttggagtgggaattttttgttagtaattataggtttttttgtttggtgtggagttgtgaatggggtttttgtatttttagttagagttggtttatttattggtatttatttttgttttttttttttagttaggttttttttattttttgttgtgtgttttgttgattatttttttttgtttgttagttttattttatgttttttattttattttaggagttgtttattttttaggtgggtttgggttgaggtagttagggtggtgaggatatttgttggtaggaaaagtaaatagagttgtttttggagtttatggtttatgagtggtttatattttttttttttgggttgttagttttttaatatttgttaaattttttttttttgtattgaggtttttaaaattttttttagtaaatatatatgatttttatatgtgtattaatatatatagatattttgtttagaagttgtttggtttttttatgtagatagagttttttgggatggtaggtttttagatatattttttttttttattatgtatttattgttatttttttatttgtttttttgtgatatgtagatataaagggtgttagttttttttatgtatttatagttaaaatttgttttttttgtgtttattggtttggagggtgtttattttgagtatatgaatttgtttattgtataagattgtatgttattttaaagtatatggttttgggaatatttgtgtatatttttttttttttatatatatagtttatgtgggttttgtgggttatgtgggtggggtagattaaagggtttaggtagtaagaagttgttttttgtttgggttttaaaaagtttgatagatattaatttggggtaggtatttttttttttaagaattggaaaaattgaaatggagatgtgttataatgagttgtgaaaagtagggagaagatgaggtttttatattgagaattgtaagggtttttgatagagttggtttttttttttatggtatttagatgtttatagttattgatatgattgtatgtgtaagaatatatatgtttttttggatagtataatgtaattttaaattaaaattagttaaggatgtgatgtgaatttagtaagttatttagttttagggtttttggttttttagaagtgttggtttttaatagaatggttttatttttttttttatttatttttttagttttaatggaggagtattgtatattttgagttttggtgttggtgaattttggggtattttgttgtgtggttagtattaggtttttttttgtagagtttttagttttagtttagattttttagagtagatattttagtgagaatttggatttattgtgttttgttagtttttggattatgttgaatttatggatttttttggtatagtattttgatttggtgtttttttgggtgtagtttttttttttttttttatgtattttttttagtagtttttgggtgttgttgtaaagggttaggatttgataggggatgtgggttattattgttggtttaggggggttggtgagtttgagtttgtttaagatttgttttttaatggtttttatttttttttttttgatgtggttgaagtttaaggtggtgtaagtggatagagagaggttgattgtggtaaagtttagtagggttaggattattagagttttttgtaagtgtatttttatgtgtgagttgggaagagaggttagggggatggtaaggtttggagaggaagagattttagtagatgtgtagaaggagggaggaaaattaggtggtttttttagattttaaagattgaggtttggtaagaaggtgtatgaatttattgtattgtgagagttttaggatttttaggaagtgttggtaattttgaggatgaagaagtggattgtgtgttttgtagtgttgggatttttgtttatgtgtttaaataggttttgttgggttttgatttttagtaggttaggtggagggtaagtagagggttgggaggggtggtaaggtagttgggagtgggaagggagttggagtttttttttaggtaaaaataaatagagtggatatttgatattgttaaatgttgtttggtgatggggagaaagtgggtattttaaagaagaagtagaaggattatggttgggttttaaaattaaaatttttgttttgttttgaaagaaaataagaaaagagaatggaaaagaaaagggaaaaaaaagtaaaaaaaaaaagattattagtgagtaggtggggagaagtagggttgggtagttgttggtttagttaaaggtgggggtagtataggatatatttgttttttaggtattttatttatgtttttttttttgtttatatttttttgggggttttttaaatgattttgtttatgttgttttttgtttttattggttggggtgtggggttatatgtattggaaggtagggaggtaggtttttgagtgtagtagttttaattatttatttagatgtttagggttattagtattttggtttgttttttgttttggttattgtttttgttttttgtttttttttaaaaaataaaaaggagaaaaaaataaaataaaatagaagttagtttatggtatgtttgttttggaaagttgttatttttttttttgtatgtttttttttttgtttttgttttttttgtttatttttttggatttgattttttgttttttttttttttttttttttttttttttttttttttttgttttttttttttttttttttatatatatatatatgtatatatattgttttttttatttttttttgttgaaattttatattttttttttatgatgtttttggtttggggtgggggagggagggattagtgtatgtagttttttttgttgtatgatgttaatgttttaaataggtataggaaaagttgagtttttttgaaaaatattttgtgagtttttttgtttgatgtggtagttgaattttttttttttttttggaattatttttgttatatgttggttgtttttttggaaagttattttgatgagtttttttttttttttttttttagttttggtgtttttttgttagttgttagtttgtgttgtttgtggtttgtgtttatttttttttttggttttttggttttggggttgtttgtgggttaggtttaatttggggtagggtttgtagagggtgtgggatttggtaggggtggttatgttagttttgtagaggggatttttagtttgtgagttgggttggagggttggtgtttgttttgtggtgattttggtttgattttttattgataagattggagttgggaggtgggtagaagtttggagatgttttaggggtagtgaaaaatggtggtgttttttggaagattgagggtgttttttggtgaggtgaggttgttagtgaaggagtttggttggttgggagttggggaggtttgggggttgggggttgtggggtgggggttgaggggtgggagaaggggttgtggtagagagtgagaaaaataagatttaggttttgaggaattgttttttttttggtttgatgtgtgtatgagtgtatttttttttttttgattgttgttttggagttgtttttgtagaaatgttatttagatgtttagtttttttttttgttgaggtttttgtagggagttgtgttagtgagtgtgaagttagtagttggtttgagtttattttttagatgggtgaggggaagttggttttgtgtttttgtttttttttttggtttgaatttttaggtttttttttatgagtagttaagggagggtagggtatgtggttttttgtattttgtaatatagggtttgtttttgaattgaatttttttgagagtgagtgttgtttttattttattttattttagtttttttggattttttttgagaggtttggt

SEQ ID NO: 755 - DNA, 3036 bp, Artificial Sequence
  chemically treated genomic DNA (Homo sapiens)
tagttttgtttttatttttgtttttttatattttattttttataaagtagagtgattttttaaaataaatttgtttatattattttttattttaaaattttataatagtttagaataaaatttaaagttttgattatgatttttaaaggttatatatgatgtagtttttgtttatatttttaattttattttttttatatttttttttttttttttttgaaatagagatggggttttgttatgttggttaggttggttttgaatttttgattttaagtgatttgtttgttttggttttttgaagtgttgggattataggtgtgatttattgtgtttagtttttaattttattttttattagtttttttttatttgatttattttagttataatgatttttttgttgatttttgaatatatttagtttatttttattttaaaatttttatttatttgtttagaaatttttttttggatttttaatagttagtttttttttattttttaggggttttagtttaaatgttattttttgagattttttttttaattatttaatatgaagaagtttttatatttagttatttttttattttagtattttgtttatgttttttttagtattagatttgggtttttttttgtttattatttattttgtttttttgaaagatttatgtgttggtattatgtgttgtttttattgtttttttaatgtttagtagatttggtatatattgatgtgtaattaatatgtgaatgaagaattattgatagatgattagttaaaagtttttgtaaagttttttgataggttattggtggagagtagggagtataaatttggggttttattttagtttgattattttttggttgtgtataaattagtttagtttttttgagttttagttatttattttgtaaattagggatgggaatatttatattttatgatgttaaatggttattttgtaaagatgaaaggaggaaatgtaggaaataattttatgtaaggttaatgttttgtaaatagagttgttattgttattatatattttatataattttgtgtttttaatggtaggatttttttagtgttttagttttgtttttttttttttgggttgatttttatagatttttttagaagagtgttttttaggtgtgaatttttgtagagtggagataaaggttgaggttttaatgtatgtgtatttatgtgagtttgggtttatgatgttattagtgtagtgttattgttgtggaaggtttaggggtttgttttgtatgtggtgtgttttagggaggtttaggtggatgtttgtaagttgggtgtgtggtttgggggtggtttggaaattttagtggaaggtagtaaggggtgtgtggggttgtggagttatgaagttgggtggtaggaggggtggtttggagtttttgtggggtatagtgtgtgtgtgagggtggttggtggggttgtttggtgtgggtgttttggtgatgtgtggtgttgaggtggtggtgggagtagtggtgttgagttttgttttggttttggttttggttttgtggtggtgtaggtggtggaggtggaggtgtaggtttttttttaggatttggtgagtttaggtttaagtggtggttttgtgaggtttttgtatggtgttttgggttgaggttttttttgttttgttttattttaggagtttgtttttttagttggggatgaggttaggaggtggttgtgtggggtttagtataaagatttgtttttaggggttgttgtttttgttgttgttgttgttgttagtttagagttgtttgttgaagtagagttggtgttggggtttttatttttattggttttgaggggtggttgttgtttgttgttatgaggtttaggggtttgagtgttgagttttttgtttttttggttgtgtggggatagggttgttgagtagtttttgttttttttggttgtgggggttttattgagtatgttggaggagagtgatatggataaagttattaaggtaagggggaggtgttttttttttttttgtgttgttttgtggtgttttttttggttttagttttaaaaagtagggagattttgtagtgagaggttttattgattattgggttttggttttttttggattttgtggattgtgttttatagttttggggttaagggttatgggtgtgggtgtaggtgtgtgtttgatttttgttagtttttttggtgagtgtgatttgtgtttagttggaatagaggtgagtggtttggagatattattaagtgttaatgaatgggatgaagagagttttattattattattatatgttttgattattttttaaggttgttagtatttgtttttggatggtttatagaatttggagagttggaatttatttattttttttgatttgtttgaaattagttttttggaaatttgtagttggaaaaaggtggtttgttgtataaaatttgttttttggggaataggttgtttttatttttttgtgtattttttttttttttttttttttttttttttttttaggaagtattgagtttatttaggaaaagttaatagtttttgtgatttaattgtatttaaattaaaagaaaagtaaatgtgtgtttgaaaattatataaataaaataagttttttaaaatttgtttttaattttttttttttttaaaggtatattttgtttatttagggttagttatttgttttgatagttgtagttaagaaattagttttatgaaaattaaatattgatgtttaaagtttgatgtattatttatttatttgtagtgttaagttagtttagtgtattgaataattttattttattttgaaggataggtatttattggtagtttggggttatttttttttttaagatagttattagtaatgattaagaatttatatttttattaattttttaggtggtgtatatagttttttaaaattattaagttattttaaagaaatttaattttttaaaggag

SEQ ID NO: 756 - DNA, 3036 bp, Artificial Sequence
  chemically treated genomic DNA (Homo sapiens)
tttttttaaagggttaagtttttttggaatgatttgatgattttgagaaattatatatattatttaaagaattggtagaaatgtaaatttttaattattattagtaattgttttgaaggggaaaataattttaagttgttaatagatgtttgttttttaagataaaatgaaattatttaatgtattgggttgatttaatattataaataagtaaataatatattaaattttaagtgttaatgtttaatttttataagattaattttttagttatagttgttaagatagataattggttttgagtgggtaaaatgtgtttttaaaaaaaaaaaaagttaaaaataggttttagaaaatttattttatttgtgtaatttttgaatatatatttgttttttttttggtttaagtgtagttaagttataggaattgttaattttttttaagtaaatttaatgttttttaggagaaagaagaggaaaaagaaaaaggggagaatatatggaaaagtgaggataatttattttttaaaggataggttttgtatggtgaattatttttttttaattgtagatttttagaaggttgattttaaataaattgggagggatggataaattttaattttttaagttttgtagattatttggaagtaaatgttggtggttttggggagtgattgaaatgtgtagtagtagtagtagggttttttttgttttatttattgatatttaatagtgtttttaggttatttatttttgttttagttgagtataaattatatttattagggaagttggtgggagttggatatatatttatatttatatttataatttttggttttagggttgtaaagtgtgatttatggaatttgggggaggttgaaatttggtagttgatggaattttttattgtaaaatttttttgttttttgaggttagagttgagaagaatgttataggataatgtgggggaagagggggtattttttttttattttgatggttttgtttatgttgtttttttttgatatatttagtggggtttttatagttgggagaggtggaggttgtttagtagttttgtttttgtgtggttgagggagtaaagggtttggtatttgggtttttgggttttgtggtgatgggtagtagttgttttttgggattggtggggatgaggattttggtgttggttttgttttggtgggtggttttaggttggtggtagtagtagtggtggaggtggtggtttttggggataggtttttgtgttgggttttatgtggttgttttttagttttatttttagttggggaggtaggtttttggggtagggtgaggtggggagggttttgatttggggtgttgtgtaagggttttgtggggttgttgtttagatttgggtttgttaggttttaaagaagagtttgtgtttttgtttttgttgtttgtattgttgtgaagttgaagttgaagttgaagtagagtttggtgttgttgtttttgttgttgttttagtgttatatattgttgggatatttgtgttgggtagttttgttggttgtttttatgtatgtgttgtgttttgtgggagttttaggttgttttttttgttgtttagttttgtgattttatggttttatgtgttttttgttgttttttgttggggtttttgagttgtttttgaattgtgtatttgatttgtaggtgtttgtttgggtttttttaagatatgttgtatataggataggtttttgggttttttgtggtgatggtgttgtgttaatgatgttataggtttggatttgtgtgagtgtgtgtgtgttggggttttagtttttatttttattttgtggagatttatgtttggaaaatgtttttttgagaggatttgtggaggttaatttaggagagagaagataggattgaagtattgaaagggttttgttgttaagggtgtaggattgtatagaatatataatagtagtagtagttttgtttatggagtattaattttatgtggagttattttttgtattttttttttttgtttttataaggtagttgtttggtgttgtgaggtatggatgtttttatttttaatttgtaaaataggtaattgaggtttaggagagttagattagtttgtgtatagttgagaagtggttaagttagaatgggattttaggtttgtgttttttattttttattgataatttattaaagggttttgtaagagtttttgattaattgtttgttaatggttttttatttatgtattaattgtatattagtatgtgttaaatttattagatattggagaaatagtaggaataatatatggtattggtatatggattttttaggaaaatgaagtaggtaataaataggaaaaagtttgagtttgatgttaagaagaatataaataggatgttgaggtaagagaataattggatgtggggatttttttgtattagatgattaaggaaggaattttaggaggtaatatttaagttgagatttttgaggaatgagaaagggttggttattggaaatttaaggaaagatttttgggtagatgggtagaaattttaaggtggaaataagttaaatatgtttaagaattagtaagaaggttattgtagttggagtagattgagtaggaggagattgataaagggtgaggttggaggttgggtgtggtgggttatgtttgtaattttagtattttgggaggttaaggtgggtggattatttgaagttaggagtttgagattggtttggttaatatggtgaaattttgtttttattttaaaaaaagaaaaaaaaaagtataaaaaggatgaggttggagatgtgggtaggggttgtattatatgtggtttttgggggttataattaggattttggattttattttaagttattgtaaggttttaaagtaaagagtgatgtgaataaatttgttttaaaagattattttgttttgtagagaatagaatataggaaagtaagaatggaaatagagtta

SEQ ID NO: 757 - DNA, 3091 bp, Artificial Sequence
  chemically treated genomic DNA (Homo sapiens)
  unsure (2411, 2632, 2656): unknown base
gtttggtgtttataatatattttgaataggttttgaaattatgggtttttagtttaaggtagtatgttatttgggtattttgagtagggaaataatgaaaaataatgtttagttaatggtataagttatttgttatttagatagtgatggtttttagagtggattgaaaggagattggttatttttgttttaaaatattttggaaattgtttgttttttgaattttgagggatgtttgggaggaggagttgataggtgatttaatgttaaatttgggtttttttttttaattgttattgtgaaaatttttaaatatatagaaaagttgaaagaattgtgtattgtgtttattatttagattttattatatggatttttatttgttttattatatttttgtttatttattttttatttatgtatggaggtatttatatattttatttttgatgtattttaaagtataaagagtattattagagtttaatgtttgtgatttttttttttttaaaaatttttgaggtaatatttatatttagtgaaatgtatagattttaagtggattattttattagtttgataaatgtttgtaaggtggaatttaagtttttattagtatttgttaaatttatgttagaggttgattagagaagtatagtttttaagatttttattttgttttgtggagaatggtaaaaatttgtgaaatattttagtagagttaggagagagtaatattggtaatgtgaagtatgttaagttaagaaaggaagtattgaaattaattgttttgaatggaatttgataagaatttgttattttatttttttaagattggatttaagttgggagagaatattgttttttgttttgtttaagttaatattattgtttagatttataaatttttttattttttaatgtttatatattaatttgtattataagttaaaataatatagagaatttggaaaaagaagaaggggaatgttttttatgaaaagtatattttttaaagtgtttggtttgagagttatatagtatgtataaaatttgataataagtatattatgatttatattgtatataataaaaagtagggtatttttgaagggttttgagaaaaagttttgggtttttaaaatttgtttaagaaggtgattaatggtatattatttttaaatgtagtattgatttgtatgttttatagttattaatagtgaaaataatagtttttaataagagttggaaatattgagttgagggttttttttttttttttaaagtttgaggttaaaattgatatttatttttttgaattatgtttatattttttttttggttaatatgtatgtggtggtataattttgaaaattatgtaatgttatagaattattatttagaaatgaattttgttaataaattttttgtatttaaattttttttattgtatagtttttgataatgttttttagataattttttttttagtaattagtatttttaaataaaaattatagagaatagtaagtttttttttttttttttggtagatttgatttagaaattgttatgggaagaaagtgttaattatattaaaaaatagtttgatagaaagtatttaaaaagagaaagggagaatattatgtttttattttggtgaattagtaataaagaaaaagattagtatggatgggtattttttaaaaatatatttttttttttttggtttttgttagggtggaggaagttgtttttttgttagagatagggtggaagagagtgaaaggataaatgattgagaggttgtttttttttattggtgtaggtgtgtgggggttggatggggggttgtggaggggggaggtggttatttggtgtttgggttttaggtttttatttttatttttgtttttatttttatttatatttagggattggttttgttttttggtgggtgagtggtaggtgttgaagtattggggtggggggtgtaaattttgtgggtagtggaaaagaggttgtggggggttttttagtgttggtagatattgtgaggttggtagttgttggtatgtatatttagtttgtagttttgaggaatatgtttgtagttagggtgtggagtagagttttgggtaggagaattaagggagggtgtgtgttgtggtggtggtggtagtggtagtggtagggggataaattttatatataattattatagtattttttttttatttattattttttttttattatttttttatattatattgtattttatatatattttttatttttttttattattttattttttgtgtagtttatgaattttttatttttattttaattaaatgttattttttttattttttatttaatttatatattaattagatttttatatntttatagtattatgttatttgtaaaattgttgtattttttattattatgttttttttaatatttttgttttttttaatttatgatttttatattatttatttattttatatattttgtggattttttatttaatttgtatttttgtatatttgaatattttttatttttgtttttatagagaatatgagaaattgtgagaatatgtaggatattttatatnttttttttaggggtttggtttttntagtttggtgattttagtggttgtagtgggtatggttgaaggattgggaggtggtggtttggtttgaattgttgtgaagaaagtgtaattatgttttgttttgtgggttaagaaattggagaaatttggagtgtattttgtttgtaaggtatgtgtttgttgtttttggattgtggatgggtgttaggggtttagtttgtgggattttttttttttttttgtttttatttttgttttttgttttttgttttttgttttttgtttggggttgttgtattgtggaagtgtttttgttgtttgtgtttaattagtttttttttggataagagttttgttgggtttgaagaagggggattattaagatggagagttttttattttttttgtttgaaaggagtagttttggtatttgagtttttgggttattttggggtt

SEQ ID NO: 758 - DNA, 3091 bp, Artificial Sequence
  chemically treated genomic DNA (Homo sapiens)
  unsure (436, 460, 681): unknown base
aattttaaggtagtttgggagtttggatgttgaagttattttttttaagtggaaggaatgaagggttttttgttttagtgattttttttttttaaatttagtaggatttttatttaagaagaagttaattgggtgtgggtgataagagtatttttgtggtgtagtggttttaggtgggaggtgagaggtaggaggtgggaggtggaggtggaagtgggagggggaggggggttttgtgggttgggtttttagtatttatttgtggtttgagagtggtgagtgtgtattttgtaggtggagtatattttgagtttttttagttttttggtttgtggagtggagtgtagttgtgttttttttatggtgatttgggttgagttattgttttttggttttttggttgtgtttgttgtagttattagggttgttggattgnagggattgaatttttgagggaggngtatggggtgttttgtgtatttttgtggttttttgtgttttttgtggaggtggagatgagaggtatttagatatatgaaaatgtgaattgaatgggaggtttgtgaagtatgtgggatagataagtggtatgagagttataggttgaagggggtgggagtgttgagaaaaatatagtaatgggaagtgtagtaattttgtggatagtgtagtgttgtgaanatgtggaggtttagttggtgtgtgagttgagtaggaggtagagaagataatatttggttgaagtaggaatagaaagtttgtagattgtgtagagaatggagtgatggagaagagtgggagatgtgtatagagtgtggtgtaatgtgagaaaatggtgaggaggaggtggtgagtggagaggaggtattgtagtagttgtatgtagagtttgtttttttattgttgttgttgttgttgttgttatagtatatgtttttttttggtttttttgtttgggattttgttttgtgttttggttgtggatatgttttttgggattgtggattaggtgtgtgtgttggtggttgttagttttatggtgtttgttagtgttgggaggttttttatggttttttttttgttgtttgtggggtttgtattttttattttagtgttttgatatttattgtttgtttgttagggggtgaggttaatttttgggtgtgggtgagggtggggatgagggtgggggtaggggtttggagtttaggtattgggtggttattttttttttttgtggttttttatttgatttttgtatgtttgtattagtgggagggggtagttttttaattatttgtttttttatttttttttattttgtttttgatagagagataattttttttattttagtgggagttagaggaaaaaaaatatatttttgaaaagtatttgtttatgttaatttttttttttgttgttaatttattaaaataaagatgtgatgttttttttttttttttttaaatattttttgttaaattattttttaatataattaatattttttttttatagtaatttttgggttaaatttgttggaggaggggaaaaaaatttattattttttgtaatttttgtttgaaagtgttggttgttaaaagaaagattgtttaaaaagtattgttaaaaattatgtagtggaaaaagtttgaatataaaaagtttgttaataggatttgtttttgggtggtggttttataatgttatgtagtttttaaaattgtgttattgtgtgtgtattaattaggaaaaagatataagtataatttaaaagaataaatattgattttggttttaaattttaaaaagaaaaaaaaaatttttaatttagtgtttttaatttttgttgaaaattgttgtttttattgttgatgattgtggagtatataagttagtgttgtgtttgaaagtggtgtattgttgattgtttttttaagtaggttttaaaagtttagggtttttttttaggattttttagaagtgttttattttttgttatatgtaatgtgggttataatgtgtttattattagattttatgtatgttgtatagtttttaggttagatgttttaaggggtgtgttttttgtgggaaatatttttttttttttttttttagattttttgtgttattttgatttgtaatgtaggttaatatataaatattgggaggtgggggagtttgtagatttaaatagtgatattagtttagatagggtaaaaggtaatatttttttttaatttgagtttagttttgaggggatgaaatggtagatttttattaggttttatttaggataattaattttagtgtttttttttttagtttgatgtgttttatgttattagtgttatttttttttggttttgttgagatgttttgtagatttttgttattttttgtaaagtagggtgagagttttaaaggttgtgtttttttgattaatttttaatatggatttaatagatattaataagagtttgggttttattttgtaggtatttgttaaattgatggaatgatttatttgagatttgtatattttattggatataaatgttgttttaaaaatttttaaaaaaagaaaaattataagtattgaattttaatggtgttttttgtattttgagatatattaaaaataagatgtatggatgtttttatgtatgggtaaagggtggatgaatagagatatgataaagtaaataggggtttatataatagagtttaggtaatgggtatagtgtgtaatttttttaatttttttgtatgtttgaaaatttttatagtgataattgggggagggaatttagatttaatattaagttatttattaatttttttttttaagtgttttttagaatttaggaggtagataatttttaggatgttttgaagtagaagtagttaatttttttttaatttattttgaaaattattattgtttgagtggtgaatggtttgtgttattaattgaatattattttttattatttttttgtttagagtatttagatgatatattgttttaggttgaaggtttgtggttttaagatttatttaaagtgtgttatgagtattaggt

SEQ ID NO: 759 - DNA, 3083 bp, Artificial Sequence
  chemically treated genomic DNA (Homo sapiens)
atttttagtagagatggggttttgttatgttgggtaggttggtttggaatttttgattttaggtgatttgtttattttggttttttaaagtgttgggattataggtgtgagttattgtgtttggtttagaaatgagatatttaattttttaatttttattttttttttttttgagatggagttttatttttgttgtttaggttggagtgtaatggtgttattttggtttattgtaatttttgtttttaggtttaagtgatttttttgttttagttttttgagtagtttggattataggtatgtgttattatgtttagttaattatgtatttttagtagtgatggggtttttttatattggttaggttggttttgaatttttgattttaggtgatttgtttgttttggttttttaaagtgttgggattatatttgtgagttattgtgtttagttaaaatgagatattttaaataatataagtaaatagaaatatattatgattttaatgataatttatgttttgaaaataaatgaagaaaggaataggagtagggaaagttgggattagagtgggtaggaagttaaaatagagtagttagggaaagttttattgaataagtgatatttggataatgattatggggagattagggaatgggttatttgaattttttgggaaaatattgttttaggtagaggaaatagtaagtgtatgatttttaaggttagagtgtgttaagtatgttggagaggttgagtttattgtagttgagttatagaagtgagtggaagagaagaaggtgatgagtttagagagggaagggtagggtaagagatgggttgtatggggttttgtaggttattgtaagaattttgtaggagggatagagattgatttggtttttattaggatttttttggttgttgtgttgagtatagattttaagaggaaagagtggaagtaggtagaatattgaggaggttgttgtagtggtttaggtgggaaatgatggtgttgattgtggaggtggtaagtggttagattattttattttatttatatttaatatatttaatattgatttaatattatttaatatatagtttatattgaaattgttttttaaattttttttatataaaaaaattattttgaatttaattaagttttatttattgtttttggtttttattttttttatgttgttatattttaaaagattttaggttagatgttgtgtagaatgttttatattttgaatttgtttatttttttaagtaagttttttgtgtgtatgtggtaagaatatgatagaggtagtaatatgttttttttattgtattatattaggagatatataataatagttttgatttattattggtggtgttaagtttgattatttggtaagggggtgtttgttagatttttttattgtaaagtaagttgttttttattgtaagttataaatatgttgtgggatgatattttgggattaaatatattttgaatatattgttgtttaataatattttatttagtgattttagtagttaaggaatagttttgtggtttttgattttgtgttttagtttgtttatttgaaaaatgaggatgattatggtttttattggatgtttgttttgaggatttgtgtttggtatattagaaatgttttataaatgttaggtattattggatgaaggtaaatatgaaaaaaattaagggtagggttaggattgtattttggttttttggattttgagggagtttttagttgatgttgggtgaaagtggttgtatgagtttatgttgttatgttttttgttgtggaagttagggtgggggttgttggaattttaggttggttgtgtaaggttttttgggattggtagtgttgggtgtggttttgggattatatattttagtggtttttgtgtggtgattttagttgttgttgttttagttgttttatagtgatggtagtggttgtggtttagttggtggtggttggtggtggttgtgggttgagtggtgagtttttgatttaaagttgagttgtgaggaaaatggtggtgggaggtgagtggagataaaggaggaggtggtggtgggtgagggggtggagtgtgaggtggagggaagaggggtgagttttttaggttgtgagagttagtggttttagatttgttaaggtattgaggggtgtgttggttgggggatgtgttgaggtagttttggggtgttggggttgtgttgtttttttttagtttggggggtggtttgtggtggtaggagttgagatgaagttgggtggtagtttgtttggggatttgagggggtttttgtgtggaggggttatttgaggagtttgtggggggattgtaggggtttattttttttttttgtttttaaagtttttttttttttttgttttttttagtttttttgaaagttttttgtgttgtttttttgttgttttggttttttagtagtttttgggatgtatgggagggaaaagttgtggggattttttttattttagttttttagttgggtgagatttggttgttgtgttttttttttatttgggtatttaaaaaatattttaatatgaattgtttgtggaatttttatgttgggtttgggtagttttttagtttttttggtaaaaaggtgttttattatttttggtgtgaaggttgggaaatggtaagtgggaagttggttgataaaattaggagtttggttgtttttattattattttttttttttttttgttttttttattttttattttatgaatattgatttagtttgttatggtttaaataaattgtttgttttgtatttgttttaataaaattagttatgggttgttgggagatttagttgttttttaggtagtttgagggtatttagggtggaaaagttaattgagagagtgagtatttattttattggtaggatttgggatttttaaatggaatgatatggaagttatgagatttttttgaagttgaaattttttttttttttttgaatgtgaagattttttttttgtaatatttgagtagggtt

SEQ ID NO: 760 - DNA, 3083 bp, Artificial Sequence
  chemically treated genomic DNA (Homo sapiens)
agttttgtttaaatattgtaaaaaggaagtttttgtatttgggagggggaaaaaagttttgattttgagagaattttatagtttttgtgttattttatttgggaattttagattttgttagtgaggtagatgtttgtttttttggttaatttttttattttagatgtttttaaattgtttaggaagtaattaagttttttaatgatttatggttagttttgttaaggtaggtataagataagtagtttatttaaattatgatgaattgggttgatgtttataaaatgagagatggggagagtaaaaaaaaaaaaaaagtagtaataaagatagttaaatttttaattttattaattaattttttatttgttattttttagtttttatattagaggtagtaaaatgtttttttattgagaaaattaagaagttatttgagtttaatatgaaaattttgtggataatttgtgttaaaatattttttaaatgtttaagtgaggaggaaatatagtaattaaattttatttggttgggaggttggggtggggggggtttttgtggttttttttttttgtgtgttttagaagttgttaaggagttggggtagtaggaggatgatgtggggagtttttaaaagggttgggggaggtaagaggaagaaaaaattttagggatagaaggggaaagtgggtttttgtagtttttttgtaaattttttgggtgatttttttgtgtggggatttttttggatttttaagtggattgttatttagttttgttttagtttttattgttgtgggttgttttttgggttgaggggaagtggtgtggttttgatattttgaaattattttagtgtgttttttggttggtgtgttttttagtgttttggtagatttgaagttgttggtttttgtagtttggggaatttgttttttttttttttgttttgtattttatttttttgtttgttattgtttttttttttatttttatttattttttgttgttattttttttgtagtttagttttaaattggaaatttgttgtttagtttgtagttgttgttggttgttattgattaagttgtagttgttgttgttgttgtggagtggttgagatagtagtagttaaagttgttgtatgggggttattgggatatgtagttttgaggttatgtttagtattattggttttagggggttttgtgtggttggtttagggttttagtgatttttattttggtttttgtggtggagggtgtggtgatgtgggtttgtgtggttgtttttgtttagtattgattgggagtttttttgggatttggagaattggaatgtagttttagttttgtttttaattttttttatatttgtttttgtttagtaatatttaatatttgtggagtgtttttggtatgttaagtatggatttttaaaataagtatttggtagggattatgattatttttattttttagatgagtgaattgaggtataaggttggaagttatgaggttgttttttagttgttaaagttattgggtgaaatgttgttgggtagtagtatatttagggtatatttagttttgaagtattattttatagtgtatttatgatttataataaagaatagtttgttttataatggaaagatttggtaggtatttttttattaagtgattgaatttagtattattaataatgggttaggattgttgttatgtgttttttaatatgatgtagtggggaaagtatattgttatttttgttgtatttttgttatatatatataaaaagtttatttgaaaaaataaatgaatttagaatgtgggatattttatataatatttagtttggagttttttaaaatatgatagtatgaaagaggtgaaaattaaaagtaataggtgagatttgattggatttaggatgatttttttatgtaaaaagaatttggggggtaattttaatgtggattgtatgttagataatattgagttagtattagatgtgttgagtgtaaataaaatagaataatttgattatttattatttttatggttagtattattattttttatttggattattgtaatagtttttttagtgttttgtttgtttttattttttttttttagagtttatatttaatatagtagttagaggaattttggtaagaattaagttagtttttgttttttttgtaaaatttttgtagtaatttgtaaagttttatatagtttgttttttgttttgtttttttttttttaaatttattattttttttttttttatttatttttgtaatttagttataatggatttggtttttttaatgtgtttagtatattttggttttaaagattgtgtatttgttattttttttgtttagaatagtatttttttagaaaatttaaataatttattttttaatttttttatggttattgtttaaatgttatttatttagtgaggttttttttaattgttttattttaattttttgtttattttgattttagttttttttatttttatttttttttttatttatttttagagtatgaattattattaaaattatgatatatttttgtttatttatgttatttaaaatattttattttggttgggtgtggtgatttatgaatgtaattttagtattttgggaggttaaggtaggtagattatttgaggttgggagtttaagattagtttgattaatatggagaaattttgttattattaaaaatatataattagttgggtatggtagtatatgtttgtaatttgagttatttaggaggttgaggtaggagaattatttgaatttgggggtagaggttgtggtgagttgagatggtattattgtattttaatttgggtaataagagtgaaattttgttttaaaaaaaaaaaaagtaaaaattaaaaaattaaatattttatttttgggttgggtatggtggtttatatttgtaattttaatattttgggaggttaaggtgggtagattatttgaggttagaagttttagattagtttgtttaatatggtgaaattttgtttttattaaaaat

SEQ ID NO: 761 - DNA, 17203 bp, Artificial Sequence
  chemically treated genomic DNA (Homo sapiens)
tttttttttgtatttttgtgtgttgtggtgttggagtttgaggtggttgtagtttatattttttgagtgatttttggtgtttgtttgttgtgtggaggtttgggttatattttattggttgtttggtttattttagttagtgttgtgttgaattttgtttgtgtgtgttggggagtggtgtttttgttgttgttgttgtgatttttggtgtttgtttttgtaatgggaggtaagtgagggttgggtttgggtgtgggattggggttattttgagggtgtggtgtttttttttttttttttttgttttagtttttgtttttgaaattgagaaattgagttgtggttagtgaaagttttgttgtgttgagatttgttggtgattttgtttttttgtttgtttgtgtgtttttttgttagatagtgggggttgaggtttttttgtttgtttgtttttggtttttttatttgtttgtgtgttttttgtttttttgaggggtttgtttgttttttttgatttttttttgggttttgtgtttgtttgtttgttgttatttattttgtgttttttttttgtgtgtttttttgagatttgatttttttgttttttgttatttgatttgtttgttttttgttttttgtgtgttttattgttttatttttatttatatttttatttttgtttgttgtttttttgattttgtttttttggagttgtgtttttggtttatgtttgttgttttttgttagtttagttgtttttttgttttattgtggggtttaggttaggttgtttgttgggttttgttttttgtttttgggtttttggaggtttgatttgtgtggtgttttttttttgttgtttttttttttggttttaagagttttttttggtttttttatttgtttttgggttgggtgtggttttagtttttattatttttttttttattttatttttttgtttttttgagattttttttagggtggtttttgtttgatatggtttgtatttgtttttaatttagatgttatttttgttgtgggggttttattagatgaggggaggaggttgggggggggggtttttttggttggtggtggagtggtagaaggagagtattattggaattgtttttatttttttagtttttttttttttggggtaggggagagttttattgagttttgttttaaatttggttagaaggatttgttgtgagtgggtggggggtttttttttttgatgtttattttgtatgtgtggaagttgtttttttgtgttaagttattggtatttgggtgtgtgggtatgttgtgtgtttgtgttagtttttgtgttgtttgttattgtgggatttgtttgtgtatgtgtgtttttttttgtatgtgtgatttgtttgtgtgtatgtgtgtatgtttgtttgtgttttgaggttttgtgtgtgttttttgtaattgtgtgtattatttttggtgtgtttgttgttattagatttgtgtgtgtgtgtgtgtgtgtgtgtgtttttgtttgttagtgtgtgtgtttttgtgtgtttggaggttttggtgttgtatattgggtatattatggtgattaattggttatgagtatgttagatttgttaattgtggaagtttttggtgttgggtgtttatttattagttttatgtgtgagtgtatttgtataagtgtgtgtatgtgtgtgtatttatgtgtggttttttttttgttattgagtttttgtgattaggtttatttggttattaagggaggggattgatttttggggtttttttgtttttgttgtggagtgagttggggtttggtgagtaggttagtagagggaggttgtatggtgtatgtgtgatatgtgtggttgtgtgtgtgtgtgtgtgtgtgatagagaggtgtggtggtgtttgggtagttgtatttggttgatgggtggtgtgagggttatgtgatgggatagtgttggggtaagtttgggagtgtgtggttatggtaggagtgtgtgattggtgggatatagtttatgaaattgttggtgtatgtttggggagtgattgtgattgtggggaattgagagtgtttgggtgtgggtgttagtggtaggagggggtgtgataaggtgtgtggtgatagtgttgggagggaaggtgagagtttagtgtgggggtgtgtgtgtgagtgtgtgggagattatgaggatgtgggtgtgtatatggagagggttagagggtaagttttggggtttgtagtgttgtgattaagattttgggttttgtatttaagaattatttgggttttaatatttgtttgtgtttgttaagagtaagagatttaagttaggttttttaaggttgagtgtttttatttgtagaatggagagagtgaggataaaagtttttgtgttaaaggttttttaatataattttggtttatagtgagaatatagtatatgtgaagttttttgttgttattatttttagttatatggtttttatttttttgggagttggggttaaagaaagtttagatagtatttaatttaattttttgtttgtttgttgtttttttttatttttttgattaagtagtttgagggaggggggatgtttagatagagtttttagtatttagttttgtttagtttgtatgatagttttttttttattagattttagtgttagtagtagtgatgggggagataggggtgggggatgatttagagttgtgattgtagggtgttgatattatttagttggtatagtttagattaaaattagaaataatttaaagtatagataaaaagataaagttaaggatgtttttgtttttagggaatggtgatgggggtttttagttgggggaggggtttatatttggggagtagaattttttttagaggtttgagttggtttttagagaaaatgtttaggttttttagttaggagatatagagtattttgttatttttgttattttttttttttaggatatttttaggttttagtttttttagttgtgtaatgggtataatagtaatgtgagaattatttgaattgtaaggtataagagattaaaaaatgttattttttagtttgggtatggtggtttatatttgtaattttagtattttgggaagttgaggtaggtggattatttggttaggaatttgagattagtttggttaatatggtgaaattttgtttgtattaaaattataaaaattagttgggtgtggtggtgtgtatttgtaattttagttgtttaggaggttgaggtatgagaattatttgagattaggaggtagaggttgtagtgagttaagattgtgttattgtattttagtttgggtgatagagtgagattttgttatattaaaaaaaaaaaaaagttattatttatttggtatttttaatatgagtttagtataggagttggtatgttatattattggaattttagaattatttggggagaagaggttagtagtttttttattaaaaaaattgaggtttagggaaattgtattaggatataaagtggtggtattttgttgtattttaggatttttaaatttgtaaggtaattttttatagataggagggttaggaataggtttttgttgtgttattggtttttttattaggttggaaatgtgtttagggtagggatatagtgttttagtttttattatggagtggataaatagtggtgtttaggaaaagttgggtttaatattatattttaaggaagggaaagttatatttagagagatttgaggttttaggtttaggagagattgaattgggtttgttagttatgttgggattggtagatggggagagtttgtttggtggtgttttttggtttagttgtttttttttgtttttataggtttgtagggaattggttaggtaagggggtaggtttgttttttttggtggttggtgtgttgtagtagtagtgggagttaggattaaggataagtaggagttgggagttttaggtaggattgagtttttttaggtagatggatggtgtattggtgtagtttttttttttggtttttttgttttttgttgtggaattggatggggttgggtatgtatgtagagtttttgatttggttgtgggttttgtgtgtttaggggttgtagttgtttgttttgtttatgaggggttttttgtttatgaggaattttttgtttaatttggttgtggttttagaatgtttttattttggagtttagaggtttggggtttattattaatttggggtaaaaagtagtaatgtttttttggttagttagagagggtggtttatgggttaaagattgagggtgggtgtgttagtttttttatggttttgtatttgttttaaatttattttattattatataaggatattgaaattttttgtgggttttatagtgggttggatattgtagggggatggaatggggtttttagttttaggtatagttgagttgttttttatattttaggtttttttattttttttagtttttttggagtttgagtagggtttagtttttttttttagtttttagatttaaggggagttaggtagagtttggaataatgttgggaaggttgtagtttttttgaatttttttagaaagttagaaattttttgttttggggtgagttttgttttttttagttttattattatgaaaatattgttgtgggtgattttatatttattttaggttggtgattgggtgattgggttttagtgaatagggtattggtggtgggtatgggtgttaatgaagttggagttttggagtaatagtggggggatagtaaagattgttttttttttaggagtgttttttgagtagatttttatagttaattttattggttgttatgtatttataggtttgtgagtagagttataaaggttgggttttttgggtttgattttgggttgggggtagaagggaggttagggtttttattttggggtaggagttgggatagaataggagtagtttttattgggttttttgtgtattggatttgtttttaaatttggtgtggaggaagtaaagtgtttttggttgtttaggggtttttgttatttaagttttgaagagttagttttttttgttatttagttttgttttgtaaggagtttgattagttttggagatagtttattgtaaatttttagatattattttttagttgtatagatatatgtgtgtttatatagggatatggtaagttaggttgtagtgggtatgtatatttatagatttatgagtttttgtatgtgtattatatatgtgggtatgtaggtatataggtgtttatatgtagttatttatggtatatttatatatatatagatgtttttttagttattgttggtatttatgtatttaaatgtttgtttatatatattgtattgtgtttattttggggttaggaaggggtttttggttagagttatagtttagttaggttgtttgtatttggtatttgaggggtaagttttaggtgtggttgtgattttagtaaggggggttgggttattttggtaggtgggttttgtttatgtatttagtagttattttgtttatttggttttaggttttaggttgattagggattggtatgggagatgggaggtatgaatgtgggggagaggttgtgttagttgtgttagtattgtgtgtttgttgttatagtagaggaagtaggttgtttggttatggggttaaggtgtttatagtgggtgggggttttattaatttttgtgttttttatggtgtttatgtttagagggagtggagttgttgggttttagggattgagaggttggtaggggttgtttgtttattttttaaagtttgggtttaggagagaggtttatttgtttaaggtgtttttggaggtttattttttttgagttgtttaggaagtggttttggagtgggattgattagttttttgttagtggttttatgttttgttttgtttttgttttgtttgtttaggggagtagtgtttggttattgggttaggttgattgattaggttttttattgttagggttgtttaggtttttttggggggttttaggagaagggtagggggtaggttatgaagttttttgtagtttttataattgtggttttttttttgttttgagtttgtaagttgaggtttaagagtattaattttggtaggtatggtttttttgagagaggtgatggttgggttgtattttagtgattaggtagtttttagtagttttatgaatgaatttgggtaagtggttttgttgtttagtgttttagtttttttttgatagatgagataatgatagtatttattttgatgaggttgtgtggaaatgatagataatatatgtaaagtagttggtattgtgtttagtgtattgttagagttgaatgagtagaaattgtagttatgtaaagtatttagagtttagtttatgggaattatttaaaaaatagtaagtgggattgatgagggggtattattatttgatgggttgggtattggtttagtgttatatggttaggtggttgtggagtttggttgaggagttaggtttttgatttttttattttttttaattttatttttagtggtagtgttttatttgtttagtaggttttatgttttttgaggagaggagtttttgttggagtagttttatttatttagtagtttagtttttgtttgttttttttttttttatttttttttaaagggagaaaatagattttgtgataaatggatgtagggaggggaaaggtagtttgtagttgtttgttgtttttttagggttttttttggttttttttagttttggttttttgtaggatattaggttgggagaattggttgggaatgagggggtggatgtaagtttttttgttagtttgtttattttttagatttttggagttagtttgtgggttggggtagggagtgggtatttgggattgatggaagttagaagagtagggggagttagaaaattttttatatttatggtagttgggggtagggtttagtttgttttagggatatgaagaaggttagtatagttagggttgggttaagtattggtttttattgtgtggggtttagaggttggggatgaggagtgttgaggagtggtaaggatagtgatgtaaatagtaggggtttgagggttggagagtgaaaggtggatgggtttgggtgggaagtgtggttgagggtattttgaaggtttaggagtaggatttttgtaggtattagatagattttggttgaatttttgtttaatatttattggttgtgtatatttgagttagggattggattgttttttatttgttttgtttgtgaaatgggtagattatggggtgtggtgttttgtgagatatgaatgatgggaaggagttattgtgtggggtggggtggagtaggaagatggaatagtaagtttagaggtttttaagtgggaaggaattggttgttttgggaattgaaaggggttagtgtggttggggtataggaatgagggaaaggtagtgtttgtttgagaggttagggaggtaatggtgatggggaggggggtggtggggggtaggttgtatggagtaggttgaggggaggagtttgggtttgttagaggggtaatgggaggtattgggggtttgggtagggggtgataaaatttgtttgaaaagttttgtttggtggttggaatagggggattgttgggttggggtagaggatggagagtagttagaagataggtgtagagtttggggatggtggtggtgggagaagaggatttgagatttgaggataggttgtagtggtagatgggatggttttattgtgtggggagtagggggagttgtttggtttgagttattgtttgagtttgtgtatttttagtggatgaggagtgttgggaggggaatggtgggggattggtgtgggtaggtttgagtttttttggagttatttatgtggtgaagttagggaggtaggtggggttataagtttgaagtttaggagggtttgggtttaaagtagagatgggagtttaaagttaggattggggaggagagggtttaataggttttttaaggggtgggggagtatttgagaggtttatgaataggattgggatggttgttttttaaaggtttttgttaaggtatttaggagggtaggtttgtggtggttgagttgttgtttttataatagttttggaagttttggattatgtttatggttgtgttgggtaaataggtagagtagagtaggtagttgttaaggtttgaggttagattagatgtttgtgtggtgtaggttgtgggttggggttgttggggtgggaggaggattttagggttttttagtgttagggttggagaaagtttagaggtttttattgttgagatagggaggttggagttttgggaggggtagtagttggttagtttttgttagtggatttatgttgtttgttttagtttagttttgtttagagttttaggttagaatagggtattttgtggttggggggtttaatagagtttttttttttattttttaaggaagtttggaagatattagagtatttgggttaagattgtggagtatttaggtagtagatttgagttaggtttgtttaggtttaagtttgttggtttttttgtttgttgtttgttgtgggatggtgtattatgtgggatggttttgttttttttttagtttttttaatatttttaaagtggggaagtattatgtggattttgtttagattttggggatgattggtaaaagggttaggtggttattttgtttttttttaaatataaaatgattgtttttaatggtaaattatttggaaaattgtgggaattttgtgggagaaagaagggttaaggagtagggtttttgtattgggggttgatggaggagttgtttttatttttaaatatatatttttattttattggaggttagatgggtagttttaggattagagttggaagttttttttttatttttttttgggtttgttttattggttttgtggttttggttgaattgtttaattttttttttggtttttgtatagtgagtttggagtttaaggaatttgtttttggggtgtttggtttgttgttttattaatataggtttaagtttttttttttttttgtgtgttaggtttgtgattgttatttgtgatttttaatttttattatagttttagggttttgtaggtaggtgggtgggtgggtggaggtttgtttagtgatgtgtttgattagtttatttttttttttatatattttagattttgttttggattaagagggattttttttgtttttttgggtggaaaggtttagtttagtttgatattagttgtttttttgttttttttttattttttagttattgtgtttgggggttgtggtggaaaaagttgtatttggattttatggtgttagattttagttagggatgtggggtttttttaggattgtatgtttgtttttgtgtttgtttggagtatttttgtgttagtgtgtatattatagtttgtggtattttatgtgtgtgtggagtttatgtggttgggtgtggtttgtgtgggtttgggtatttgttgagatgtgagagttggtgagtgtatgtgtgtttttgtgtgtgtgtgtgtgtgtgtgtatgtgtgtttttgtgttattatagtagtgtgtgtatgtatttgtggttttaattgtgtgtgtgtgtgtttaatgttgagtggggttttttatgtgttgtttgggttggtgagtgtgtttgtgtgtatatgtgtggttatttgtggagaggtttggttgtattttttattttggttttttatagaggttttttgtttttataggatttggttttttggtttttgttatgaaggggtttttgttttttttttaggggtatttggggtattgttttttgattgagtttaggattttttatattttagggttggttggtgatttgaggtttgtgtttggtggtttttttttaaggaggttttattttatataagttggtagaggtggatgtgagttgatgatagttaggtttttaagttttgtttttttgaattttttagattttttggtagggtaggttattatgtttttgttgattttttagattgaaggtttttagttaataggtttttgtagtttttgtttttttttagttttttttattttttgttatttattgtttgtgtggtgtattttatagaggttttattattttttgtaattatatatttatgtgattggtttttattaggttgtaagttttatgggtttggtgtggtagaggttattagtgggaaagtagttagttttttgagaggtgggaagggttttttagggttagttttttgagttgtttggaaggatttgtgggaatttagaaggttgttttagttgagggaataatatttgtaaaaatatgggggttgggaaatgagatatatgtttatagagtagttagaatagggattgaggtagagagtaggatagggttagggagtgggtagtttggaaggtttggagaggtttgggttttttttaggggtagtgagagtttaggaggtttttagttgtgggaagaatgggtaggggagggattagagatggtgataattgggagggagttgggtaaggggaggagaggttataggtattggttggtttgtgtggggtgagggaggggtttaggaggagtgttggttgggggatgaggtatttgttttgggaggagtaggtatggggagtatttttgttttgggatttggttgtgatttgagtttatagatttggtttttattttagtatagggttgggtatgtggaggttgggggatgggttttggtggaggaattttaaagggttttgttagtttttttttttttattttttgttttttttgttgagtttattttttgggttgtgaaatttgtatggtttttttgttttgtttttgttgggaaggttatttaggtagttagttttttagtttagttattatttatttgtttatttaatttggtagttttattatgtttggtttttttgttttgttgtgattgttggtattagttttgtatttttttgttgattatatttttttttattgttttttttgtttttgtttgggttttggttttttttgtttttttttatttatttataaggttttggtaggttatattgtggatttttttaggtagagtttgtatttttaggagggtttttattttgtgttatttgttatgtagttgtgatttttgtggtaggtgttaggtgtgtgggggagaaggttgtagtaggtggtatgggggatattttttgttttttgggggtttgtttaagggaattagattgttttatatttattaggggttgtaattggttttttattgtttttgttttgattgattttagtttgttattttattttttttatagatgtttttgaggtagtttttttttgtttttatatatttttttgttagtagtttgattaagttttttttttttagtttagtttatttttttgattaataggtattattttgtggtttgtgaggtagaattgaatattagggaaggggtggggtggaggggattaggttggatttgggagttagggaattttattgtaggattttggttttagtttttttttttgtataatgaggagatgggtatgttagtttttgaagatttattttttgtggagagattgttggggttttttatttttgataaaattattatttaataagttatatgtgatgtagaaaaattagtaaatgtatttttgtttttgttggtgttttttaggttatgttttttattttagttttttgtgttggtatatattagtatatgtgtggatgtgtagtatatatatttgtttgttggaggtaattaggatttttgtgtttgggagttttaaatttaaggttgttttgattattttgaggttagttttgtttattgttgggtattggttgggaataggtttttatttgttttagaggaggtgatttgttttttttggtttgatttagttattatttttttttatttttgggttgttgatttggggtttatattttttggggttgggatttagtgtgtttaagttttttttaggttttgtttttgttttatttgtttttagttttttttagatagagtgttattttattgattaggttggagtgtagtggtaagattttggtttattgtaatttttattttttgggtttaagtgatttttttgttttagttttttaggtaggtgggattataggtgtttgttattatatttggttaaattttgtattttagtagagaaggggttttatttgttggttaggttggttttgaatttttgattttaggtgatttgtttattttagttttttaaagtattgagattataggtatgagttattatgtttggtttttttttgggttttggaaatggaggttggtttaagtggtgaggttatgggggaagattattggttaagtatggggtatttgttttttggagtttttatttttttgttttttttgtttttatgtgtgtttgtgtgtgttgatttttatttttattgttttttgtttatttttatttttttttttttttttgttttttttttttaatatggtatattggaaaggatttgggttgtaatattgggtaggtttggatttatttttttattatttattggttgtgtgattttttggaaagttattttgtttttttgagttttagtttttttattagtaaaattttttttggatttgtatagggataatgtgagttaatgtaattatagaggtaatttgtgatattgttggttttagaaaaggattgttttttttgtaagtggaggagttaagatttatatttagatattgatttttagtttggtgttttgtgttttataaagttgtttttgttgtaggttggagaagtagaatagagattaggagtttttaggtagttgggaaaggtttggttggttttagttggttttaaggagtttgtttttatggaggttgtgtggggttgagtttttggtattttttggttttgtagagtggttatgagtttggggttgagttagtggtttttttttggggtttttgtggtttaggttttatttgtatgggggttataaatagttagtatattttgtttttgtgttgttgttttatttttatttttttgttatatattttgagaggtagggggtagattttgattttgttgtgtagagtagggatttgtggtttagagaggtttaggatttttttgagggttatatagtgatggaagaagatgtggggttttgggtagtataaatagggatagagttggtggtagaatttggttagagtttatgttttggttttagttttaggaggttgggtttgatgttatggttattgttggttagttttagggtagtttatgaagattatggttttttagtttttatggtattgtagtttggtagtgtaggtttagggttggggtttgttgtgtttgtggttttttttttagtggtttttaaatgtgagtagtagttgttttgagtgtggtttgagagagttggagggttatttttgggtgggtaggttttgggttttgttttatttttttggggtttttttgatttattgttttttttattttttatgtagttttggggtggtttttatgtatattttttgttgggtaggttgggggtaggggaagttatggagtttgtgggttgttagggttgggttttaagggttggtggttgggaggaggatttggttggttggtgttggagtatttggtgtttttgagtgagttgtatgtttatggagatttggtttttttttttgagtagtgggatttgtaattaggattgtttttttaggttgttgggtaggtggaatggatgtggtgggggatgtgagtgtgttttgtaaattgtgaagggaggtgtatagtgagggatgggtgttgtagtgaggggggtgatagtggtaagaggaattttttttttatggtttgttgggttgattgtagtttttattttatgtgagtttttattatttttataattttgagttaagagattattgtttattaggaaatgggggggttgaggtttagaaaggttaagtgatttgtatagagtttatagttaaggtaatgttggtgttaggatgtagtatttaggtggtttggttattattttgttatatgtgttgttttgagttttttttttttaggagtttaggttatttgtaatatatttgttttttttttatttttgtgtttttgtttttttaatttttattattttttgaggtatttagaagttgtttattgttttatttgggtttttaggtttttttaatagtagagttgtatttgttgggattaggttttggatgtgtggatatagatttgttaattattttagatttagggagtatttatttgggtgttggattttttggatttttagggataagttaggtagtaaaaggggtaagatgtttattttgtttatgggtttgggatgtttatttagatttttgtatatgtgtgaggttaggtttatgtagtttgttttttattttagtattaattgagtgtttattatgtgttatttatttttatggttgtatataattatatttttgtagatttgtgtaattttatatatattgatttatgtatgttgtagtttggggagtagttagtagtagtttttaattggttttttttttttggtttattaagaggttaagggtagttggtttggtatataggttatttgttggtgttaggttgaaggttttgggatttgggtttaggtatgagtttgtatatttatttttatatttattgagtaggagttagggttgggtaaggaatgtggtggggtttgtttttgttttgtttgggttttgttttttgttttggtagttgttggttttagagggttgtttggatttattgggttgggttgtagggtgaggttagtatttgttgtgagtttatttgagttgggagtttttagtagagttggttattgttttggttattttgtgtaggagttggaggaagttatttggggttgggtagttgttgtgtgtgtatgtatatgtgtgtgtttgagtgtgtttttgtgtgttggtttatgtttaggatggagtgaatatatgtgtatgtgtataaaattgaatgagtgtttttttaattaaggttatggagtagttttgtggggtttgggtaggagttagtgtgtatataggtgtttgtatatttgtgtgttttttataagtggtaatttgaggagttttttggagttatttattgtagtgaatattaatttagagaatggtgagaaatttaggagtgtgggaggttgttgtgtatgaatttgtaaggtatatttagtgttatatttaatattaaaatatagtttgggttttttttaatttttatttttttgaggtagagttttgttttgttgtttaggttggagtgtaatggtgtagttttagtttattgtaatttttgttttttaggttttagttatttttttgtttttagttttttaagtagttgggattataggtatgtgttattatgtttggttagtttttgtatttttagtagagatggggttttattatgttggttaggttggttttgaatttttgattttaggtgatttgtttgttttggttttttaaagtgttgagattataggtatgagttattgtgtttaggtagtttgggttttttttttaagagatagggttttattttgttatttatgttggagtgtattgtgtggtattttgttgttttgaatttttggttttaagtgatttttttattttggttttttgaagtattaagattatgggagtgagttattatgtttatttgttttatatttggggaaataattagtttgaaggtgtaggtaattttttaggtaagtgagaggtatttgattttaaggggttaatttagaagggttaggtatattgatgtgggtagagttttttattgttttgatttttgaatagagtgggtgttaagttagtggaatgttagtttttggttttgattttttgttttagggttttagtttttttatttgaaaagtggggggtgtttattttggtattgtttgtttgtttgggtagttatgaagaaaaaattttaaatttagaaaattatgaagggttgtatggggtaggatgggagaaagaggtagtattgttttgtttttttattaggtgataatggtatatattaggtgtttggtatggagtaggtatttagtaatagggtatttagggagttattgagtgattttttaaatgaatatttaggggtgatagatgtaaatgttattagggtttaggtaggaggagtgaagagagtgtttttggtttggggtagattgatggagggtagttattttagtgttagttggttgttgtttagtgggtttaatattatattttttagttttattagagatgttgtaaatttagatttatataaattttttaatattttttttttttttttttttttttttttttttttgagatggagtttggtttttgttatttaggttggagtgtattggtgtgattttggtttattgtaatttttgttttttgggtttaagtgatttttttgttttagttttttgagtagttggaattataggtatgtattattatatttagttaatttttagtagagatggttttttattatgttggttaggttggttttaaatttttgattttaggttatttgtttattttggttttttaaagtgttgggattataggtgttagttattgtgtttggtaaattttttagtttttaatattggtaattgagattagtgtgtgtgtgtattatgtgggttaaatttaattatagtagagttttgggggagtgggtttttgagtgttgtttgtgattgtttttgttggttttgtttggttgtttggttttatttttttgtgtgtata

SEQ ID NO: 762 - DNA, 17203 bp, Artificial Sequence
  chemically treated genomic DNA (Homo sapiens)
tgtgtatatagaggggtgaggttaggtggttgggtgggattagtgggaatagttatgggtagtatttagggatttgtttttttagggttttgttatgattgggtttggtttatatgatgtatatatatattagttttagttgttagtgttaaaaattgagaggtttgttaggtgtagtggttgatgtttgtaattttagtattttgggaggttaaggtaggtagatggtttgaggttaggagtttgagattagtttgattaatatggtgaaaagttatttttattaaaaattagttgggtgtggtggtgtatgtttgtaattttagttatttgggaggttgaggtaggagaattatttgaatttgggaggtggaggttgtagtgagttaagattgtattagtatattttagtttgggtgataagagttaaattttgttttaaaaaaaaaaaaaaaagaaaaagaaaaagaaaaatattgagaggtttatgtaagtttggatttgtggtgtttttggtaaaattggaaaatgtgatgttgggtttattgggtaatagttagttagtattgggatggttgttttttattaatttattttaggttaggggtattttttttattttttttatttgggttttggtggtatttgtatttgttatttttagatatttatttggggagttatttagtgattttttaagtattttattgttgggtatttgttttatgttaggtatttggtatgtgttattgttatttggtaaggggataggatagtattgttttttttttttattttgttttatgtagttttttatgattttttaagtttggggttttttttttataattatttaggtagataagtagtgttaagataaatattttttattttttagatggggaaattgaaattttaaggtagagaattagaattaaaagttgatattttattaatttggtatttattttgtttagggattagggtagtgagaggttttgtttatattagtgtgtttgatttttttaaattgattttttggggttgagtgttttttgtttgtttggaaggttgtttgtatttttaaattaattatttttttaaatataaaataggtgggtatggtggtttatttttataattttggtattttaggaggttaaggtaagaggattgtttgaggttaagagtttaaggtagtagagtgttatgtagtgtattttagtatgggtggtagagtgagattttattttttaaaaaaagaatttaaattgtttaggtgtggtggtttatgtttgtaattttagtattttgggaggttaaggtaggtgagttatttgaggttaggagtttgagattagtttggttaatatggtgaaattttatttttattaaaaatataaaaattagttaggtgtggtggtgtatgtttataattttagttatttgggaggttgagggtagaagaatggttggaatttgggaggtagaggttgtagtgagttgagattgtgttattgtattttagtttgggtaatagagtgagattttgttttagaaaaataaaaattaaaaaaaatttaaattgtattttaatgttgaatgtaatgttgaatgtgttttgtagatttatatatagtagttttttatatttttgggttttttattattttttaagttaatgtttattatagtaagtgattttaaggggttttttaggttgttatttgtgaaggatatataggtgtgtaagtatttatgtgtatattggtttttgtttaggttttataaggttgttttatagttttggttgagggagtgtttatttgattttgtgtatatgtatatgtatttattttattttgaatataagttagtatataggggtatatttagatatatatgtgtgtatgtatatataatagttgtttagttttagatgattttttttagtttttgtataaggtggttagagtagtggttagttttgttgggagtttttagtttagatgagtttatagtaaatgttgattttattttgtagtttagtttagtgagtttaggtagttttttgaggttagtagttgttaaagtagagagtaggatttaggtagggtaggggtagattttattatattttttgtttggttttggtttttatttagtggatgtgagagtgggtgtgtaagtttatgtttgagtttaagttttgaagtttttagtttgatattagtaggtggtttgtgtgttaggttagttgtttttgattttttggtgggttagggagagagggttagttgggggttgttgttggttgttttttaggttgtagtatgtatgaattggtgtgtgtgaggttgtatgggtttataggaatgtgattatatatagttatgggagtgggtggtatatggtgggtatttagttgatattggagtgaaaagtaagttgtgtgggtttggttttgtatatgtgtaggaatttgggtgagtattttaaatttgtaagtaagatggatattttgttttttttgttgtttggtttgtttttgagggtttaagagatttagtatttaggtgagtgttttttgggtttggaatgattggtaggtttgtgtttatatatttagggtttaattttagtagatgtagttttgttgttaggaaaatttggagatttagatggggtagtaggtaatttttgagtgttttggaggatgatgagggttgaggggataggggtatagggataaaggaggagtaagtgtgttgtaggtggtttgggtttttaggggagagaggtttagggtagtatatatggtaaaatgatggttaggttgtttgggtgttgtattttgatattaatgttgttttggttgtggattttgtgtaggttatttgatttttttgagttttagtttttttattttttgatgagtaatagttttttggtttagggttgtggggataatgagaatttatgtaggataagggttataattaatttaataggttatggggagggggttttttttattattattattttttttattgtggtatttattttttattgtgtatttttttttgtagtttataaagtgtatttgtattttttattgtatttattttgtttgtttagtagtttgggaagatagttttggttatagattttattgtttagaaagggaaattaggtttttatgaatatataatttatttaggagtattagatgttttaatattggttagttaggttttttttttagttattaatttttggggtttagttttgatagtttataggttttatggttttttttatttttggtttgtttagtaggaggtatgtgtggggattattttaggattgtatggagggtggaggagatagtgggttagagaagttttaggagggtgaggtagagtttaggatttgtttatttaagggtggttttttagtttttttaggttatatttagagtagttgttgtttatatttagaagttattggagggaaaattataaatatagtaggttttagttttaaatttgtattgttaggttgtagtgttatgagaattggggagttatggtttttgtgggttgttttgagattaattagtagtaattatagtgttagatttaattttttaagattaaaattagggtatgggttttggttaggttttgttattaattttgtttttgtttgtattatttagagttttatatttttttttattattgtgtgatttttagagaggttttgggtttttttgagttataagtttttgttttgtatagtagagttagagtttgttttttattttttagagtgtatggtagggagatgggggtgaagtagtagtataaaagtaaggtgtgttgattatttatagtttttatgtaaataggatttgggttatggaggttttagaggaaggttgttggtttagttttagatttatggttattttgtagggttagggggtgttgggggtttgattttatatagtttttatggggataagttttttggagttagttgaggttagttaggttttttttagttgtttaagggtttttagtttttattttgtttttttagtttatagtagaggtagttttatgaagtataaagtattagattaagggttagtgtttaggtatgaattttggtttttttatttataagaaggatagtttttttttgaggttgataatgttgtagattatttttgtaattatattagtttatgttatttttatgtggatttagaagggattttattgatgaagaaattaaagtttagagaagtaaagtgattttttaaaaggttatatagttagtaagtgatggaaggataaatttaggtttgtttgatgttgtagtttaggttttttttagtatgttatgttgggaagaagagataaagagagagaaaagggtagagatggatggaagatggtagaggtggagattagtatatataaatatatatgaagatagagaaaatagggaggtaagggttttaagagataggtattttatgtttgattagtggtttttttttgtgattttgttatttggattagtttttatttttaaaatttagggaagggttaggtatggtggtttatatttgtaattttaatattttgggaggttgaggtgagtagattatttgaggttaggagtttaagattagtttggttaataagtgaaattttttttttattaaaatataaaatttagttaggtgtggtggtggatatttgtaattttatttatttgggaggttgaggtagaagaattatttgaatttgggaggtagaggttgtagtgagttgagattttgttattgtattttagtttggttaataaagtgatattttgtttgaaaaaaattaaaaataaataaaataaaaataaaatttagggaaggtttggatatattggattttagttttagggaatgtgagttttagattagtagtttagaggtaaggaaaggtagtagttaggttaggttagagaaggtaggttattttttttgggataaatggaaatttgtttttagttagtatttggtagtgggtaaggttggttttaaggtgattagagtgattttgggtttggagtttttgggtatagaagttttggttgtttttagtagataagtatgtgtgttgtatatttatatgtgtgttgatgtatattagtataggaggttggggtgagggatatggtttgaggagtgttagtaggaataggaatgtatttgttaatttttttgtattatatgtaatttgttggataatggttttgttaaaggtgaaaaattttaataatttttttataagagataggtttttagagattgatatgtttatttttttattgtatagaggaggaaattaaggttaaggttttgtagtgaggttttttggtttttagatttggtttggttttttttattttattttttttttggtgtttaattttgttttataggttatagaatgatgtttgttggttagaggagtaagttgggttggaggaaagaggtttgattaggttgttggtggggaggtgtgtgagagtagagggaggttgttttagaaatgtttatgggagaaatgaggtgataggttgaggttagttaaagtaagggtaatgaaagattagttgtagtttttggtgggtatagggtggtttggtttttttgaatagatttttggggagtaggggatgttttttatgttatttattgtagtttttttttttatatatttgatatttgttatggaagttataattgtatggtaggtggtataaagtgagggtttttttaaggatgtagattttgtttgggggagtttatagtgtagtttgttagagttttgtggatgaataaaggagggtggaggagattaaggtttaggtaggggtagaaaggatagtgagaggaagtgtgattagtaggagggtgtaggattggtattggtagttatggtagggtaagggggttgggtatggtggagttgttaggttgggtaggtaggtgggtggtagttgggttgggaggttggttgtttagatggtttttttagtggaaataaggtaaggaggttatgtaggttttataatttaggaagtgggtttagtaagaggaataggaggtgggaggggaaaggttagtaagattttttagggtttttttattagggtttattttttagtttttatatgtttagttttgtgttgagataagaattagatttatggatttaggttatagttaagttttagagtagggatgttttttatatttgttttttttaggataggtattttattttttagttagtgttttttttgggttttttttttattttatatagattaattagtatttgtggttttttttttttttatttagtttttttttggttgttattatttttggttttttttttatttattttttttatagttgggaattttttaggtttttattgtttttggagaaagtttagatttttttaggttttttagattgtttattttttggttttgttttgttttttattttaatttttgttttggttattttgtgaatatatgttttattttttagtttttatatttttgtagatgttgtttttttagttggaatagttttttgaatttttatagatttttttaggtagtttagaaggttggttttgggggattttttttattttttaggaagttagttgtttttttattggtaatttttgttatattaggtttatggaatttatagtttggtgggagttagttatataaatatgtgattataaaggatggtaagatttttgtaggatgtgttatgtaggtagtgagtagtagggagtgaggggggttggaggagaatggaggttgtagggatttgttggttgggggtttttgatttgaggggttagtaggagtataatggtttgttttgttagagggtttggaaggtttagaggggtaggatttgggagtttggttgttattggtttatatttatttttgttagtttgtgtggggtagggtttttttggagggaggttattaggtataggttttgagttattagttagttttaggatatgaggagttttgggtttagttagagggtggtgttttaggtatttttgagagaggaataaaggtttttttatggtaggagttagagagttagattttgtgaggataaggggtttttgtgaggagttagggtgggggatgtagttgggtttttttatgaataattatatgtgtgtatataggtatatttgttaatttaaatagtatatagggagttttatttgatattagatatatatgtatatagttggagttataggtatgtatatatattgttgtgatgatataggggtatatgtatatatatatatatatatatatagaaatatatatgtatttattggtttttatattttaatagatatttgggtttatatagattatatttgattatataggttttatatgtatgtggagtgttataagttgtgatgtatatattggtatagagatgttttaggtagatatagaaataaatatatagttttggaaggattttatatttttgattagagtttggtattatgaagtttaaatgtagttttttttattatagtttttaggtataatggttggggaatggaggaggggtagaagggtagttggtgttaggttaggttgggtttttttatttagggagatgaagaaagttttttttgatttagagtaaagtttaaagtgtgtaagggaaggagtgggttggttaggtatattattgggtaggtttttgtttgtttgtttatttgtttgtagggttttgaggttatggtggaggttgaaggttataggtggtagttataggtttggtgtgtagggggaggggagggtttgaatttatgttggtagggtagtaagttgggtattttaggagtaagttttttgagttttaggtttattgtgtagaaattgaaagagaggttgagtaatttaattaaagttataaagttaatggggtagatttagggggaagtggggagagaatttttagttttagttttagaattgtttatttggtttttaatggggtgagggtatgtgtttggagatgggaatagtttttttattagtttttagtataagagttttattttttagttttttttttttttatagagtttttatgattttttagatggtttattattggaaataattgttttgtgtttgggagaaggtaagatggttatttaatttttttgttagttatttttaggatttgggtaggatttatatgatgtttttttattttggggatattgagaaagttgggagagaggtaggattattttgtatggtgtgttattttatagtaggtagtggatagaggaattggtgagtttggatttagataggtttagtttagatttgttgtttgggtgttttgtgattttggtttaagtgttttggtgttttttagatttttttggaaagtgggaaaagaggttttgttaagttttttagttgtagggtgttttgttttggtttgaggttttgggtagaattgggttgaagtaggtagtatgagtttattggtagaggttggttagttattgttttttttggggttttagtttttttgttttaataatggagatttttaagttttttttagttttgatattggaggattttgggattttttttttattttaataattttagtttataatttatattatgtagatatttgatttagttttaggttttggtgattgtttgttttgttttgtttgtttatttaatatggttatagatatgatttaaagtttttggagttgttgtgaaaatagtggtttagttattataagtttgtttttttgggtgttttggtagagatttttgagggatagttattttagttttgtttgtgggttttttaaatgtttttttattttttagaaggtttgttgagtttttttttttttaattttggttttaggtttttgtttttattttgggtttagatttttttgaattttaggtttgtggttttatttgtttttttggttttattatatgaatgattttagaagagtttaagtttgtttatattagttttttgttgttttttttttagtgttttttatttattaggagtgtatgagtttaggtagtggtttaggttagatagttttttttgttttttatataataaggttattttgtttgttgttgtagtttgtttttaagttttaaattttttttttttattattattatttttaggttttgtatttgttttttgattgttttttattttttattttggtttgatagtttttttgttttagttattagatggggttttttagatagattttgttattttttgtttaagtttttagtgttttttattgtttttttgataagtttagatttttttttttagtttgttttatgtagtttgttttttgttatttttttttttattattgttatttttttgattttttgggtaggtgttgttttttttttatttttgtgttttagttatgttgattttttttagtttttgaagtagttagtttttttttgtttaggagtttttgggtttgttgttttgtttttttgttttattttattttatatagtggtttttttttattgtttatgttttataggatattatattttgtgatttgtttattttatagatgaggtaagtggggaatggtttagtttttggtttaagtgtgtatagttagtaaatattgagtaaggatttaattagggtttgtttgatgtttgtagaagttttgtttttaagtttttaggatatttttaattatattttttgtttaggtttatttattttttgttttttagtttttaggtttttgttgtttgtattattgtttttattattttttaatattttttatttttagtttttgggttttatatagtgaaggttaatgtttagtttaattttaattgtgttgattttttttgtgtttttgggataggttgggttttgtttttagttgttatgggtgtagggggttttttagttttttttatttttttagtttttattagttttagatgtttattttttgttttagtttataggttgattttaggggtttgaagggtaagtaggttggtaggagggtttatgtttatttttttgtttttagttaatttttttagtttaatgttttgtaggaggttagagttggagagggttaaggggagttttgagggggtagtaggtagttgtagattgttttttttttttttgtatttatttgttatgagatttattttttttttttgaaagggagtgagggggagaagagtaggtaggggttggattgttgagtgggtggagttgttttaataggagtttttttttttggagggtatggaatttattgaataagtagggtattgttattggaggtagaattgagggggatgagggagttagagatttggttttttagttaggttttatagttatttggttatgtaatattgggttagtgtttagtttattagataataatatttttttattagttttatttgttattttttgaatagtttttatgaattgggttttaaatgttttatataattatagtttttatttatttaattttgataatgtattaagtatgatgttagttattttgtatatgttatttgttatttttgtataattttattaagatggatgttattattattttatttgttagggggagattgaggtattgagtggtagagttatttgtttaggtttatttatagagttgttgggagttgtttagttattaagatgtagtttagttattattttttttaagggggttatgtttattagagttgatgtttttgagttttggtttataggtttagagtaagaaaggagttatggttgtggggattgtaggggattttgtgatttgttttttgttttttttttagagttttttaaaaaggtttgggtagttttggtagtgaaaagtttggttagttagtttaatttggtggttagatgttgtttttttgggtaggtaaggtaggggtggagtaaggtgtagagttattgatagagggttggttagttttattttaaaattattttttgggtagtttagaggaagtaagtttttggaaatgttttgaatagatgggttttttttttaggtttaggttttgggaagtgaatagatagtttttgttaattttttagtttttagagtttagtaattttattttttttaggtatggatattgtgggggatataggagttgataggatttttatttattgtgagtattttggttttatggttagatagtttattttttttgttgtagtagtaggtatatagtgttggtatagttgatatagttttttttttgtatttatgttttttattttttatgttaatttttggttggtttggagtttggggttaggtgggtagggtggttgttgaatgtatgggtagagtttatttattagggtggtttagttttttttattgagattatagttatatttggaatttgttttttaggtgttagatgtaggtgatttgattgggttgtaattttgattagggatttttttttgattttagaatgggtatagtgtggtatgtgtgggtaggtatttgagtgtatggatgttaatggtaattgggagagtatttgtgtgtgtgtgagtgtgttatgggtggttgtatgtgagtatttgtgtatttgtatgtttatatgtgtggtgtatgtataggaatttatgagtttgtgggtgtgtatgtttattgtagtttagtttgttatatttttgtgtgagtatgtatatgtttgtgtagttggagggtgatgtttgagggtttatagtgggttgtttttaagattaattaaattttttataaaataaggttgagtgatggaaagggttggttttttagaatttaggtggtagaggtttttagatagttaaaggtgttttattttttttatattaggtttagggataggtttaatatatagaaggtttagtgaagattgtttttgttttgttttaatttttattttagagtgaaggttttgattttttttttgtttttaatttagagttaggtttaggaagtttagtttttatggttttatttatagatttataggtgtgtaatagttagtagggttggttgtgagggtttgtttagggagtatttttggaggaaagatggtttttgttatttttttattgttattttgaggttttagttttattagtatttatatttattattagtattttgtttattggggtttggttatttagttattagtttggaatgagtatggagttatttatagtaatgtttttatggtaatagggttgaaggaggtaaggtttgttttaaaataaggaatttttagttttttgaggggatttaaagagattgtagtttttttagtattgttttagattttgtttagttttttttgaatttggaagttgaagagagggattgagttttgtttgggttttagagaagttggggaaaatggaggggtttggggtgtggaagatagtttagttgtatttggagttggagattttattttatttttttgtagtgtttaatttattgtggggtttatggggaattttagtgtttttgtgtgatgatgaggtgagtttgaggtagatatagggttatggaaaagttgatatatttatttttaatttttggtttatgagttattttttttaattgattaaaaaagtgttattattttttgttttaaattaatggtaggttttaggtttttgagttttaaggtgagagtattttggggttatagttaggttaggtaggaagttttttatgagtagagagttttttatagatagggtaaatagttgtggtttttgggtatatagggtttataattagattaaggattttgtatgtatgtttaattttatttagttttatagtaaaggataaagaggttagagaggaaggttatattggtgtattatttatttgtttaagagaatttagttttatttggggtttttagtttttgtttgtttttagttttggtttttgttgttgttataatgtattaattattaggagaaatgggtttgtttttttgtttggttagttttttgtagatttgtaggaataggaggaaatagttgagttgggaggtattgttaaataggttttttttgtttattagttttagtatggttgatgggtttagtttagttttttttggatttaaaattttgggtttttttggatgtggtttttttttttttgaaatgtggtgttgggtttaattttttttgggtattattatttgtttattttatggtaggggttggaatattgtgtttttgttttgagtatatttttagtttggtgaggaagttaataatatagtaaaaatttgtttttgatttttttgtttgtgggaggttgttttgtaggtttaggagttttagggtgtaataaagtattattattttatgttttggtgtaatttttttgagttttagtttttttaatggggaaattattagttttttttttttaggtggttttgaggttttaatgatgtggtgtgttagtttttgtgttggatttatgttgagaatgttaaatgaatagtgatttttttttttttttaatgtggtagggttttattttattgtttaggttggagtgtaatggtatgattttggtttattgtaatttttgttttttggttttaagtgatttttgtgttttagttttttgagtagttgagattataggtgtgtgttattatatttagttaatttttgtagttttggtatagatagggttttattatgttggttaggttggttttaaatttttgattaagtgatttatttgttttggttttttaaaatgttgggattataggtgtgagttattgtgtttagattgaagagtgatattttttaattttttgtgttttatagtttaggtgatttttatattattattgtgtttattatatagttgaaaaaattgaggtttggagatattttgggaggaagaaatggtaaaggtagtaaggtattttgtgttttttggttgaaaggtttaagtattttttttgaaggttagtttaagtttttaagaaagattttgttttttagatgtgaattttttttttagttggagatttttattattattttttgggggtagaggtatttttggttttatttttttgtttgtattttaaattatttttaattttaatttaaattgtgttagttaaatggtgttagtgttttgtagttatagttttgaattattttttatttttgttttttttattgttattattgatattaaggtttggtgagggaggggttgttatgtaggttgaatagggttgggtattgggggttttgtttgggtatttttttttttttaagttgtttggttaaggagatgggaaggggtaatagataggtaggaaattgggttggatattgtttgggttttttttagttttagtttttaggagaatgggaattgtatagttgggggtggtgataataaaagattttatatgtgttgtgtttttattatgggttaagattgtgttaaaggatttttaatataggaatttttgtttttattttttttattttgtagataaggatatttagttttgagaggtttagtttgggttttttgtttttaataggtataagtaagtattggagtttaaataatttttgggtatagagtttgaggttttggttataatattataaattttaagatttgttttttagttttttttatgtgtatatttatatttttatggttttttatatatttatatatatatttttatattgggtttttatttttttttttagtattgttattatatattttgttatatttttttttgttgttaatatttatgtttaggtatttttggttttttataattatagttattttttaagtatatattggtagttttatagattgtgttttattagttatatatttttattgtggttatatatttttaggtttattttagtattgttttattgtatagtttttatattatttattagttaggtatagttgtttagatattattatatttttttgttatatatatatgtatatatataattatatatattatatatgtattatatagtttttttttgttggtttgtttattaagttttagtttattttatagtaggaatgaggaaattttagggattagtttttttttttagtgattaggtgggtttggttatagaaatttagtggtagagggagagttatatgtgagtatatatatatatatatatttatatagatatatttatatatgagattggtgggtaggtatttaatattaggggtttttataattaatagatttaatgtatttatggttagttggttattatgatatatttagtgtgtaatattgaaatttttagatatatagggatatatatattagtaggtaaggatatatatatatatatatatatatatgagtttggtgataataaatatattaagaatggtatatatagttgtaaaagatatatatagagttttaggatataaatagatatatatatatatatataagtaagttatatatgtgaaaaaggatatatatgtataggtaagttttatagtgatagatagtatagaagttgatatagatatataatatatttatatatttagatattagtgatttagtataaggagatagtttttatgtatatagggtaggtgttagagaaggggattttttgtttatttatagtagatttttttgattaggtttaaggtggggtttggtggggtttttttttgttttaagagagagggaattggggaagtgggagtagttttgatggtgttttttttttgttgttttattattagttaggaggatttttttttttgattttttttttttatttggtggagtttttataatgggagtggtatttgggttgggggtgagtatagattgtattgggtaggggttattttgggaggggttttagaggggtggaggggtggggtgggaagggggatggtggagattggagttatgtttagtttagagatggatgaagggattgagaaagatttttgagattgaaagaagagatagtgaggaggaggtgttgtgtgggttgggtttttagggatttaggggtgggaggtgaggtttggtgggtggtttggtttgggttttgtggtagagtggagaggtggttggattggtagggggtggtgagtgtgggttgggggtgtggttttgggaggatgggattgagggggtggtgggtgggggtaggggtgtgggtgggggtggggtgatggagtatgtggagggtaagggatggatggattgggtggtgagggatagaaggattgggttttggagaggtgtgtagggggagaatatagagtgggtggtgatagatggatggatatagggtttgggagagagttgggagggatggatgggttttttggaggagtgggagatatatgggtgggtggaggggttgggagtgggtagatagaaggattttagtttttattgtttagtggagggatatatagatggatagggggatggagttattggtaggttttggtgtggtgggatttttgttgattgtggtttagttttttagttttggaaatgggaattggggtgggaagggggaaggaagggtgttgtgtttttggggtagttttgattttgtgtttggatttggtttttatttattttttgttgtaggggtaggtgttaagggttgtggtggtagtggtgggggtgttgttttttggtgtgtgtggatggggtttggtgtggtgttgattgggatgggttaagtggttagtgaggtgtggtttgggtttttgtgtggtgggtgggtgttgggggttgtttgggagatgtgggttatagttgttttgggttttggtgttgtggtatatggaagtgtggagggggg

SEQ ID NO: 763 - DNA, 10001 bp, Artificial Sequence
  chemically treated genomic DNA (Homo sapiens)
ttaagggatttgtttgttttggttttttaatgtgttggaattataggtgtgagttattgtgtttggtttaataaggaattttttaaataaagttttgtggggttgattagattaatttatattttttgagtagattttggtataatttattatttgtagtattgaatgttaaggtttgttttttattttgaaattatatttttttttttttattggaattgaaattttatttttttatgaaatgatagtgatggtggatggtatttgttttttttaatatttttatttgataaaataaaagttagtaatttattttgatttttaattttttgttggtgtttgaaattttaaaattgagatttaaagtatagttttggttttggagagatttttaggagagttagagtttagaagggagtaggatttaggaggtttttattttttagtattttagttgagttagttgggttatggaatattattgagtaattaaaatattattaatagataaaaaaagtttattgaatataaaatttaaaggtattaatagttttgggtttaagagatttatggtaggaagttaagagttttgttttagggttggtttgggtagttttggaagaagttattgtatatgatagtgatgagtgttaggaaaatagtatatttttggaagtttatttgttggttattgtttttatttaggttgtttattagtttttttagtttttttttatttatttttttttgaaagtgataggaaatatatttattattaagttagttttaattttagttttattaaatatttagatttttatatatttaggttggtttttagttttttttttttattgggtagttgggtataaggtgggtaggaggttttgggagttattaagagggtttagtgagtaaggagagagatagatatttattggtgagtatttttagtgtgttttttttttggatatagggaggatattggatgtttttttgagtatgtattagtttgaattttataggagtttagtgaggtaggtattattattttattttgttgatgaggaaattgaaggttgttgttttttaatattagttaggtagatttagaaaagaatattttttattttttaagataaggttttgttttgttgtttaggttggagtgtagtggtataattataatttattgtagttttaattttttgggttttagtaatttttttattttagttttttaagtagttgggattataggtttatgttattatatttagttaattgtttatttttagtagagataaggttttgttatgttgtttaggttggttttggtaattagagtgattttattttgttatttaggttgtattatagtttattgtaattttgaatttttgggtttaagtaatttatttaagtagttgggattataagtgtatgttattatgtttggttaatttttatttttatttttgtagagatggagttttgttatgttgtttaggttggttgaatttttgggtttaagagatttttttgttttagttttttatattgtggggattataggtataggttattgtatttagttgaaaaatatttttttaatattagttgaaataattagaaaaatttaattagttataaaaataaaattaaaaaaaggaaagaaggatttgttttatgtgtttaaagtttgatatttaattttgggaattattaatgagttagtatagggagggtgagggataaattgaaggttgatgtatttttttataaaatgttttagattatatattttagttgggtttttttatttttatatatttttttagtttggtatataaaaatggaaagaggttaagtatagtgttttatatttgtaattttaatattttgggaggttgaggtgggaggattgtttgaatttaggagtttaagtttagtttggataatatagtaagattttatttttataaaaataaaaattggttaggtatggtgataatatttttgtagttttaattatttgggaggattgtttgagtttaggagtttgagattatagtgagttatgatttagtttgggtgatagagtgagattttgtttttttattataaaaaaaaaaaaaaaaaaaaggagtttgggtatggtggtttatgtttgtaagtttagtatttttagaggttgaggagggtagattatttgaggttaggagtttgagattagtttgattaatatgatgaaattttgtttttattaaaaatataaaaattatttgggaagttgaggtaggtagattatgaggttaggagtttgagattagtttggttaatatggtgaaattttgtttttattaaaaatataaaaattagttgggtgtagtgggatgtgtttgtagttttagttatttaggaggttgagataggagaattgtttgatttttggaggtagaggttgtagtgagttgagattgtgttattgtattttagtttgggtaataagagggaaattttattttaaaaaaaaaaaaaagaaaagaaaagagagagagagaatgtgttagtgttgtgtgattttgggataattattttttttttttgggttttggttttttaagtttttaatgataggattaaatagatggatttggaaggtttttatagtatatggttttttggaatgttgtaggaaatagttattaattaagtatttttatttgggttttatttttattttagtggagttatgaagttaaagtggggagggggttgggttttattttggtatttgtattgataggtatttggaattgggggagagatttaatttgtatttttatatttatattaggattttttttataggtttgtgttatttatttttataaagttgggtagttttttgtgtagaagtttttttattttttttttatttagtttgaatttgttgtttttttggtaggagtatttgtggaaggtagtgattagtatagttagtgtttgttttagagaattgtatattatggatttgtggttgtagaggtgttaggtgatgggtatattgttgaggtttttggggttttagtttagtttgtaggatttatttttgttttatgtttttaagttattttataaaatttttttttgaatgggaaggtaggggttgtattttttttttagattgtggttttttgaggttggaggtgatatttttattttattttgagggtagatgttaaagttttttttgtgtttgggagttattaagttttttttgatggtatttgggatatttttttgagggtagggttttttattttagtgtttgttagaagggaaatgatagggtgattagagttttattttgatggtatttgtgtaggttttggggagtagggttatatgtattggttggtagatgggggtttttgtgtagtttggtaggagttatggttatagtttaggagtaggaagttttttgaaggagttgtttttttttttagatttgggatttttgaagttagaggtatttttttttgttatttaattggaagtttttttgggtaggagtgtttttttttttagattaggagtttttagagggtggggaatgtgtttttttttattttgaaggtttttgagtttttaggtagataggggtatggatagggtgggggtaatttaatattttttttattaggaaggattttgttggaattagaattaaagatatgaaatgtttattgttttgggattaggatgggatagattttagtggtaaggtttttgagaatatttagattagtttggaaaggttaggtaggttttagggtgaggttagaggagttatgttagaggtagggtatgttttgggtttattatgttagttttgtttttattgaggtagggggtagagttttgttgtttggggttatgatttaggtagagttttgagatttttgttttttgtattttagttttgttagaatttaggattttgtaaaaaaaaaaaaaaaaaaaaaaaaaaattttaggattttttttgtagtaatgtttatatgtatattttttgtttttaggtttagatttttaaagaagggtttttagattgagatatttaggggagggttttagagtaatttttgtattgagattttatagaggaatttggagaaaaattttttagttggttgggtgtggtggtttatttttgtaattttagtattttgggaggttgagatgggtggattatgagattaggagattgagattattttggttaatatggtgaaattttatttttattaaaaatataaaaaaattagttgggtatggtggtgggtgtttgtagttttagttatttgggaggttgaggtaggagaatggtgtgaatttgggagggggagtttgtagtgagttgagattatattattgtattttagtttgggtgatagagtgagattttattttaaaaaaaaaaaaaaaaaaaaaaaattttttagttaatattttagtattttatagagagtttttttaagggggaaggtttagagaggtttaggttgattttattagggaagttggaatgagagaattgtggagataaagatagagatttatggggattttttttattttgtttttagtaggatagaggtatttattagattaggtggtagagatagatttaggaaggagagtaaggtagttaggtttttagggtgaggatttatatgtgggttttattggtttttaatttggtattttaaggaaattaaatttgttttaatttgattttattaaattttggttttttgttatttttatttatttttttttagtttttttttttttagagagtgttagttttattattagttgggggagggttttaggttaggttaagggtagtttttgagtttatttaggttatagtgggaagtgggaggtgttgtggggattgggtattttggattggggtgaggggaggtaatttttgttttggggtttggagattggtgttaggttttatttttatgatatgtttgtgagttatagtttatttttgtgtgagaggttgtgagtatatgttgagattttatggtttagtgtttgtgtatatatatgtgtttgtgtgtgtgagagagaagtaatttggggttatttttaggaagttgggggttagaggaggtagttgggggatattaggaggagaaggataggattgattttagggtatggatgaagtggagtgatttttaatggttagtattagaatattttttaatgaggtaatgaggtaattaagtgtgtttagaaatatttgggaaggtttttttgtgtaggaaggtgtttggaaggatggggaagtagtgagaaatggggttgttttatatatagttgtagttgggttgggttatagtttgtggggagtataaggaagttttaagtagttaaaggttgaataggaaaattttggtttttttttttttagtttgagggttgggtgggtgggtaggggtatatttttatttaaggttgaaaatattagttggatagttttttaagttagaatttaggtttgaagtatagtttttagttatagtttttttttattgttttttatatatatgttttttttagatttggagaaaggtaaatattgtggttatttagagtttagtttaagggagggttgtttttttttagggtttttttttttttggttttttgtttattttggtttgtttgggtattagggtattgttttttttgtggttttagtttttttttttgttttagttgttgagtagttttttttttttttttagtttttttattttagttttaagtgatttatttgaggttttaggtttagatgtttaggtagtgatttagtggtatattttttttttttagggttagggtagtagtagttttagagtagtaggtggaagttttagtttagtttggtagggaaagtattggtatagagattttaaataggttttgttaggaggagttttggataatgatatggtaggaggattagattgagaataggttggtttttttttagtggttattgtgtgatttgggggttagtttgagtagtgtatatgaagttaggttttggggtttttagtgtttttttttatattttggtatagttattgagtgttttttgttttttttagtatttgaattttttatgttatttgtttttttattgaggtttattttaagtagaatttggaataaaaattttttatattgagggtgagggataagggagtgtaatgtattgatttttatagttattttttttttttaattaagggtttttatagggttttttttgtttagaaattgtagtgtatttttatggttgttttttaaagttaggtggtatgtttttatttataagtgggagttgaataatgagaatatatggatatagggaagggaatattatatattagggtttgtgggtagttgtggggagaaggatgggggtaaggggagggagagtattaggattaatatttgatgtatgtggggtttaaaatttagatgatgggttgataggtgtagtaaattattatggtatatgtatatttatgtaataaattatattttgtatatgtatgttagaatttaaagtaaaaataaaataaaattaaattaaaattaaaaatttttaaaaagtttggtagtgaggtgttttagatttggtttgttgttgtgtgttttttaaatatattggtatatgtaattagtgtggttaagatttttggtttgtgttgatttttttgtttagaatgtgtttatatatgtttatgttttttattttgttgaaatttaattttttttttaaaggttattgtagggagtttttttagggtttaattggatttagtgtttatttgttttgttttgtataaagtgttttttttgttttttttgtgtgtatttagagaattttgattttgattgaattatttgtgtatttgtttttttttagttttatttttatatggtgagtttattggttttatttatttttgtatgaggtaagggttttgtttatattaggtgttaattagtgtttatggttattatatggtaataggggttattggaggagtgtttaggagtaagggagttttttttattttgtgaaattatattattgattatgttatgaaataattattttttttttggattttaagagtggaattgagataatgggttggaaaagagttttagagagttataaatttttgaggagtgatagtaggaaattgtggtttttaggatttagtgagggagttgagtaaattttttagtgggtagagatggagataggtaggtagatgaagaagataaagagttagttagatggaaaagttagggagaaaaatagagatagtagtagagttgtgggttattagggttagtttttgaaggtttgtttttaattaggtgtttttgttttaggaattgaggttgtgattgtgtttattaaatggttatatatttgagattggtgataattgtatttatttgttattaatttgttgtgtaattttgggtaatttttttttttatggtagggtaggagagttgtatggaatggtttttagagtttgattttaattttatttttatattttttagttgtttataaaggtagagtagttaagatataagtaggttttgtggatatttaaagtagtgattttgttttggtttagttttaggaagttgggtttttatattttgtttattttatttttgggttttaggtgttagaaattttttattagtggttttgtgggattttgtttagttgttttgtgttttttggtggttaaggtgtgttattgtagtgttggttttttgttatttttttttttttgtttgttagattttttggtgttttgtttatgatttaaataggagatagtgttgatttatttttaagtggtttttttatatttatatttgttttatatagatgaggttttttggatagtttttgtttagaagtttaggtggatgtttgagatggtagttagatatttggaagttattttaaaagtttagggatatgggtatttgggagataggaggtggaaagattatttgagtttaggagtttgaggttgtagtgagttatgattgtgttattgtattttagtttggatgatagagtaagattttgttttaattaattaattaatgtaagtttagagataagggtaggagaaaattaggggatagaagtgagggattggttattgttaagttttgtttatttattttttttttttaggttgtttaggggaaagagaaatggttttattgtgggggttataggtttagtttaagttttgatattgtttttggtttattgtgtgattgttgattttggttgagtggtgttatgaatttgagtttaaatgtttttagtagaaggattttttttattatgttttgttttataaaataagttttgaggtattttgttttagtaaaatgtattaaataatttattttttttgttgtattaattggatttataagtgttttttggtagtatgattagtatgtgaggatttatgttattatattgggtttaggttattttggatttgttatttataatgggtgtgtgtatattttttgttggggggtgtagattgaaattttgaagtatttgttgtgtgttaggtgttttttgtatattattttatttaatttatataataattttaggagttggaataagatgattttattttatagaggagaatattgagatttaaagtttgttaaatttatataattagtaaggggtggggaggtatgatgaatataggtggttataatgttaaattttttttagaagttttaattattttttgataattttgagagttttaatattttatttttatttagattagttttagtttttttgtttattttttttttattttatatttagtttatttgttttattttttaattttagtaggtgttagaagtttattttttttttatttttgattttggtattttttttttttgtttttaaatgttttgtggattggattttttttaatttttgtttatttatttatttgagatatagatttattgttgttaaggttggagtatagtggtattattatagtttattgtagttttatgtgatttttttatattaatttttttagtaattggggttataggtgtgtgttattgtgtgtatttttttgtattttttgtggtgatggagttttgttattttgtttagatgggttttgaatttttgagtttaagtaatttttttgttttggttttttaaagtgttgggatattaatgtgagttattatgtttagtttagtttggattaaatataaatataaaagagattgggtatggtggtttatatttgtaattttagtattttgggaggttgaggtaggtagattatttgaagttaagagtttaagattagtttgtttaatatggtaaaattttatttttattaaaaatataaaaattagttaggtgtggtggtataagtttgtagttttagttatttagggaggttgagttaggaaaattgtttgaatttgggaggtagaggttgtagtgatttgagattatgttattgtattttagtttgggtgaaagagtaagatttttttttaaaaataaattaaaaatgaatatgttatttaatttaatatttttattgttaaatatttattttatgttgttatttttttattagtatgtaggtatataaatagatatttgtaagaaggaagaaatggatataagaaaaatttttattaataaaggattgggttgggtatagtggtttatgtttgtaattttaatattttgggaggttagggtaggaggattatttaagtttaggagtttaagattagtatgggtaatataatga

SEQ ID NO: 764 - DNA, 10001 bp, Artificial Sequence
  chemically treated genomic DNA (Homo sapiens)
ttattatattgtttatgttggttttgaatttttaggtttaagtgatttttttgttttggttttttaaagtgttgggattataggtatgagttattatgtttagtttaattttttattgatggaaattttttttatgtttatttttttttttttgtaaatatttgtttgtatatttatatattggtggaaaaataataatataaggtaaatgtttggtagtagaaatattaggttaagtggtatgtttatttttaatttgtttttgagaaaggattttgtttttttatttaggttggagtgtagtggtatgattttgggttattgtaatttttgttttttaggtttaagtgatttttttggtttagtttttttgagtagttgggattataggtttgtgttattatgtttggttaatttttgtatttttagtagagatggggttttgttatgttaggtaggttggttttgaatttttggttttaggtgatttgtttgttttagttttttaaaatgttgggattataggtgtgagttattatgtttagttttttttatatttatatttaatttgggttaggttgggtatggtggtttatgttggtattttagtattttgggaggttgaggtaggaggattgtttgagtttaagagtttaagatttgtttgggtaagatggtaaaattttattattataaaagatgtaaaaagatgtgtatagtggtgtatatttatagttttagttattgaggaggttaatgtgggaggattatatgaggttgtagtgagttgtgatggtgttattgtattttagttttggtgatagtgagtttatgttttaaataagtaagtaaataaaaattaaaaagaatttagtttatagggtatttgaaggtaagaggaaaagatgttagaattagagatggggagaagatgggtttttggtgtttgttgaggttgagaaatgagatagataggttgagtgtggggtggagagaggatgggtagagagattgaggttggtttgaatggaaatgaaatgttagggtttttagggttattggggaataattggagtttttaggaaaggtttaatgttgtgattatttgtgtttgttatgtttttttattttttattaattgtgtgaatttggtagattttgagttttagtgtttttttttgtgaagtggggttattttattttaatttttgggattgttgtgtgaattaaatggggtaatgtatggagagtatttgatgtatagtgagtgttttaaaattttagtttgtattttttagtaaaggatatgtatatgtttattgtgagtgataaatttaggatgatttgaatttaatgtgataatgtgggtttttgtatgttggttatgttgttgggagatatttatggatttaattagtataataggggaaataaattatttaatgtattttgttaagatagaatattttagaatttattttgtggggtggggtataataaagggggtttttttgttgaaaatgtttaagtttaggtttgtggtattatttaattaaggttgatagttatatagtaagttagaggtaatgttaggatttaaattaaatttgtggtttttataatgaggttattttttttttttttgaatggtttggggaaagggggtgggtgggtagaatttggtagtggttaattttttatttttgttttttggtttttttttgtttttatttttaggtttgtattgattgattgattgagatagggttttgttttgttgtttaggttggagtgtagtggtatgattatggtttattgtagttttaaatttttaggtttaagtggtttttttgttttttattttttgagtatttatatttttaggtttttaaaatggtttttaggtatttggttgttgttttagatatttatttgggtttttgggtagggattgtttgggaaattttatttatgtgaagtaggtgtgggtgtaggaaggttgtttggaaatgaattagtattgttttttgtttgagttgtaagtagggtgttagagggtttggtggataagaaagggaggatgataggaggttggtattgtaatgatatgttttagttattagagggtatgaagtagttgggtaaaattttgtggggttgttggtggaaaatttttggtatttggagtttggagatggggtggatggaatgtgaggatttagttttttgaggttgggttggggtagagttattgttttggatgtttgtagggtttgtttgtgttttgattattttgtttttgtagatagttggagaatgtgagagtgggattgggattggattttaggggttattttgtataatttttttgttttgttgtgggggagggagttgtttaaggttatgtagtaagttagtggtaaatgaatatgattattattagttttaggtatatggttatttgatgggtgtagttgtagttttagtttttgagatagagatatttgattaaggataggtttttaggagttgattttagtgatttgtggttttgttgttgtttttgtttttttttttggtttttttatttgattgattttttgttttttttgtttgtttgtttgtttttgtttttgtttgttggggggtttgtttaatttttttattgggttttgggagttgtagttttttgttgttattttttagggatttgtagttttttgaagtttttttttgatttgttgttttggttttatttttgggatttagaggagaggtgattattttgtagtatagttagtggtgtgattttatggggtgagaaggatttttttgtttttaagtatttttttagtgatttttgttgttatgtggtagttgtaagtattggttggtatttggtgtgggtgagatttttattttatgtagaaatgagtaagattggtgagtttattatgtgggggtgaggttgagagaaaataagtatataggtgatttagttaaaattagaattttttaagtatatatgaaaagggtaaaaggggtgttttgtataggatagaataggtagatattgaatttggttgggttttgggaaggttttttgtagtggtttttgaagggggggttggattttagtaggatagagggtatgggtatgtgtgggtatgttttgaatagaggggttagtgtaagttgagggttttggttatattagttgtatgtgttggtgtgtttaagggatatgtagtagtaggttgagtttggagtgttttattgttaggttttttaaaaatttttaattttaatttaattttattttatttttattttaagttttggtatatatgtgtagaatgtggtttgttatataggtatatatgtgttatggtggtttgttgtatttattaatttattatttaggttttaagttttgtatgtattaggtattagttttaatgttttttttttttttgtttttatttttttttttgtaattgtttataggttttggtatgtggtgtttttttttttgtgtttatatgtttttattgtttaatttttatttatgagtgagaatatattgtttggttttaagggatagttatggggatgtattgtagtttttgagtagggaaggttttgtggaggtttttagttaaaaggaaagaatggttgtgaaaattgatgtattgtgtttttttgttttttatttttagtgtgaagggtttttattttgagttttatttgaagtaggttttgatgggaagataagtagtatgaggggtttaagtattgaggggagtaagggatatttggtggttgtgttaaggtgtagaagaggatattgggggttttaaggtttgattttatgtatattgtttaggttggtttttaagttatatggtgattgttaggaagggattagtttgtttttagtttgatttttttgttatgttattatttaaagttttttttggtagggtttgtttggggtttttgtgttagtgttttttttgttaggttgggttggggtttttatttattgttttgggattgttgttgttttggttttgggggaggagggtgtgttgttgagttattgtttgggtatttgggtttggaattttgggtgagttatttagggttgaggtagaggggttgggggaggggaagaagttatttgatagttggagtagggaggggagttggggttataggaagggtggtgttttgatgtttagatgggttgggatagataaagggttaaggaggaaggggttttgggagggggtagtttttttttgggttgggttttgaatggttatagtgtttgtttttttttgggtttggggaggatatgtgtgtggggggtagtgagagagggttgtggttgagggttgtgttttaggtttggattttggtttgggaagttgtttagttggtgtttttagttttgggtagggatgtatttttatttatttatttagtttttaagttggagaagaggaggttaaagtttttttgtttagtttttaattatttgggatttttttatgttttttatagattgtggtttagtttaattgtggttgtgtgtagagtaattttattttttattgtttttttatttttttagatatttttttatatagagggatttttttaggtatttttaagtatatttagttattttattattttattaagaggtattttggtgttggttattaaaagttattttattttatttatgttttgaagttagttttgtttttttttttttgatgttttttagttgttttttttggtttttagttttttaagggtggttttaggttgttttttttttatatatataggtgtatgtatgtatatgagtattggattatgaagttttagtgtgtgtttatagttttttatataggagtgggttgtgatttataggtatgttatgagaatgaggtttggtattagtttttaggttttagagtaggggttgtttttttttattttggtttaggatgtttagtttttatgatattttttattttttattgtggtttgggtgggtttaggggttgtttttgatttggtttagagtttttttttagttggtggtggagttggtattttttgggagggagggggttgggagggaatgagtgggaatggtaagaggttagggtttggtgggattaggttgaggtaggtttggtttttttaaaatgttaagttgggggttagtggggtttatatataaatttttattttgggagtttggttgttttgtttttttttttgggtttgtttttgttatttggtttggtgagtatttttgttttgttgagggtagggtggggaggatttttgtgggtttttgtttttgtttttatagtttttttattttagtttttttggtgggattaatttgggtttttttgggtttttttttttggaagaattttttgtgaagtgttgaagtgttgattgaagggttttttttttttttttttttttttgagatggagttttgttttgttgtttaggttggagtatagtggtgtgattttagtttattgtaaatttttttttttaggtttatgttatttttttgttttagttttttgagtagttgggattgtaggtgtttattattatgtttggttaatttttttgtatttttagtagagatggggttttattatgttagttaggatggttttgattttttgattttgtgatttatttattttggttttttaaagtgttgggattataggagtaagttattgtgtttggttgattgaagggtttttttttaggtttttttgtgaggttttagtgtaggggttgttttgaggtttttttttggatattttagtttaggggtttttttttgggggtttaggtttaggagtaggaggtgtgtatgtgggtgttgttgtaaaaagaattttgagatttttttttttttttttttttttttttgtaaagttttggattttagtaggattaaggtgtaagaggtaggggttttaagattttgtttgggttatggttttaagtagtaaagttttgttttttgttttggtgaaggtagggttggtatgatgggtttagggtatgttttgtttttggtatagtttttttggttttattttgaaatttgtttaatttttttaggttggtttgagtatttttagaggttttgttgttgaggtttgttttattttgattttaaggtaatgaatattttatatttttaattttaattttaataggattttttttggtggagagaatgttaagttgtttttattttatttatgtttttgtttgtttagaggtttaggggtttttagggtgaggggagatatattttttattttttgggagtttttagtttgagagaggaaatatttttgtttaagggagtttttagttagatggtagagagagatgtttttggttttaggagttttgagtttaaggagggaaatgatttttttagggagttttttgtttttaggttgtagttatggtttttgttagattgtataggagtttttatttgttagttggtgtatgtggttttgttttttagagtttgtgtagatgttattaaaatgggattttggttattttgttattttttttttggtagatattaaaatggggagttttgtttttaggggggtgttttaagtgttattagaggaggtttggtgatttttagatataagggaagttttagtgtttgtttttagggtgagatggaggtattgtttttggttttagggaattatagtttgagggggagatgtagtttttgtttttttatttagagaggggttttgtgaggtggtttgggggtatagggtagaagtggattttataggttgagttaaggttttaagagttttagtagtgtatttattatttggtatttttgtagttatagatttatgatgtgtagttttttggagtaggtgttggttgtgttggttattattttttataagtatttttgttaagagggtgataagtttaagttgagtaagggggaaatgaaggaatttttgtataaggagttgtttagttttgtgggggtgagtggtataggtttgtgggggaggttttggtgtgagtgtgggggtgtaggttaaattttttttttagttttgggtgtttgttgatgtaggtgttagggtggggtttagttttttttttattttagttttatggttttattggagtggaaatgaggtttgagtgggagtgtttaattaatggttgttttttgtagtattttagagaattatgtgttgtgagggttttttgagtttatttgtttaattttgttattggagatttgagaaattagagtttagaagggaaaagtgattgttttaagattatatagtattggtatgtttttttttttttttttttttttttttttttttttttgagatggagttttttttttgttgtttaggttggagtgtaatggtatgattttggtttattgtaatttttgtttttaggggttaagtaatttttttgttttagttttttgagtagttgggattataggtgtattttattatgtttagttaatttttgtatttttagtagagatagggttttattatattggttaggttggttttgaatttttgattttgtgatttatttgttttggttttttaagtgatttttgtatttttagtagagatggggttttattatattggttaggttggttttgaatttttgattttaggtgatttgttttttttggtttttgaaagtgttgggtttataggtgtgagttattgtgtttggattttttttttttttttttttttttgtggtggggggataagattttattttgttatttaggttggattatagtttattgtaattttgaatttttgggtttaagtaatttttttaagtagttggaattataggagtattgttattatgtttggttaatttttatttttgtagagatggagttttgttatgttgtttaggttgggtttgaatttttgggtttaagtaatttttttattttggttttttaaagtattggaattatagatgtgaggtattgtgtttgatttttttttatttttatatgttaaattaagaaagtatgtagggatagaaaagtttagttaagatatatagtttgggatattttgtggagaaatgtattgatttttaatttgttttttattttttttatattgatttattggtgatttttaaagttaggtgttaggttttgaatatatgaggtaggttttttttttttttttttaattttgtttttgtggttggttaaatttttttaattattttggttagtattaaaaaagtgttttttagttgggtgtagtggtttatgtttgtaatttttatagtgtgggaggttaaggtaggaggattttttaagtttaggagtttgattagtttgggtaatatagtaagattttatttttataaaaataaaaataaaaattggttaggtatggtggtatatgtttgtagttttagttatttgggtggattgtttgagtttaggagtttaaggttatagtgagttataatatagtttgggtgataaagtgagattattttggttgttaagattagtttaggtaatatagtgaggttttgtttttattaaaaataaataattagttgggtgtggtggtatgagtttgtggttttagttatttgggaggttgaggtgggaggattgttggagtttaggaggttgaggttgtagtgagttgtgattgtgttattgtattttagtttgggtaatagagtaagattttgttttaaaaaataaaaagtgtttttttttgaatttatttggttggtgttggggagtagtaatttttggtttttttattagtagaatggggtgatgatatttattttgttgggtttttgtgggatttgagttgatgtatgtttagaggagtatttagtgttttttttgtgtttaggaggagggtatattggagatgtttattaatgagtatttgtttttttttttatttattgggtttttttggtagtttttagggttttttgtttattttatatttagttgtttagtggggagggagagttgggaattaatttgaatgtgtgagggtttgggtgtttggtggagttggggttggggttggtttggtgatgagtgtattttttgttatttttaggagaaagtggatgaggaggggttgaagaagttgatgggtagtttggatgagaatagtgattagtaggtggatttttaggagtatgttgtttttttggtatttattattgttatgtgtaatgattttttttagggttgtttagattgattttgaagtagaatttttgattttttgttatggattttttgggtttaggattgttgatgtttttgagttttgtatttaataaattttttttgtttgttgataatattttaattgtttagtgatgttttataatttggttggtttagttggagtgttgggagatgagggttttttggattttgtttttttttgggttttgatttttttggaaatttttttaaggttagagttatgttttaggttttaattttggaattttaaatattagtaaaaaattggaaattgagataggttgttgatttttattttgttaaataaagatattaaaaaaggtaaatattatttattattattattattttataaaaagataaaattttaattttaataaaggaggaaaggtataattttagaataaaggatagattttaatatttaatattgtaagtaatgagttgtattaggatttatttaagagatatgaattagtttaattgattttgtaaagttttatttaaaagattttttgttagattgagtatggtggtttatatttgtaattttagtatgttgggaggttaaggtaggtagattttttga

SEQ ID NO: 765 - DNA, 7001 bp, Artificial Sequence
  chemically treated genomic DNA (Homo sapiens)
atgatattagtaattgtttagtgaggtggatataaaatttttaggatatgagagggagatgtggtttttatattttgatgtgtaaatattatgtttagggaaaatgtaaggtgttttaggtttgtggattttgtatttttttaggtaatttatttatttattttttaattttaataaatgattattaaattttatttaatatataaatatttattgagtattatttgtgtgtatgagaagtgggagttagtatggtaaaagttaggtattgtgttaggtgagagagatttagaaattaaaattagagaagttattaataagagtttaaatatttgggtttaggtttatgtttgtaattttagtattttgggaggttgaaggaggtgaattatttgaggttaggagtttaagattagtttgattaaaatggtgaagttttatttttattaaaaatataaaaaattaggtgggtattgtggtatatgtttgtaattttagttatttgggaggttgaggtaggagaattatttgaatttaggaggtagaggttgtagtgagttaagattgtattattgtattttagtttgagtgatagagtaagattttattttaaaaaaaaaaaaaaaagagtttaaggatttgatggaggagaaaggtaagaatatgtgtgagataatgtaaggttattgttttagggtgtttagggtaattatgggggtagggtattttttggagaggttaatgataagtaggttgaataaagtaggggggttttttgtaggaggaggtttattaggtgaagatggagttgtatgggtaaaggttattttagagatttaggtgtgtttaggaggtggaaatttattgtaggtaaggtgagaggattgggtggggtggtttaggaggagttgatagagggtataagttgtgaaatagtttgaagtagggtagtgaggaaagggatttagaggaggaagatatgtggatagatggggttggttgggggttgttgtaggattttatgtaagaggttttaatattagagttttaggttttgagttttgtggaattaaaggttttagaaagtaatttattaggatttggtggttgatagtttgtagtagggggtgaaagaggagtttagagtattttttggtttttgtttttgttttggggtataggaggggaggaatttagtttggttatattggtttaggtgagggtgttttaggggaggttgagaggggttgtttttttgtttgttttgttattagggattgttttgagatgtttttggagaaagtgtttttggtttgttgggaaggatttgtgtttagtttttgttgtttagtagtttttatgggaattttgtttttttggggtttggatttattgtgatgtgaaggtgattattgtttatttttgggatattgtgggggttaagagaggttttgtggtgagggaggattattattttgggggttgggggggttttttttttagggaggaagatttttagttttggtgttttgtttttggtagattttgttttgtttatttgttttgtttttgttgtatgatggaaataaatggaaatggtttttatatatgaatgtattaaattgtaattataattttttagattttagttgtaataggattatggatttgagtgatttgtaaagatgttttgagttttgagttagagggtgtgtggggtggggaggggagtttgttatggtttttgtgattttatagtatagggggtagagttgggggttggggtgggggtaagggtgtaggtagatgggtttgggggtggttagtatggggatttatttagtttgttttgtatattgaggttatttttttttttgggttttaaagtttttttgttttttgttatgggtttgggggtttttttattgtagtttaatgttggttgtttttttatgttgtttaagtttattttttaggtttggtattttatagtagagattaagaggtggttggagggtagtgggggtatggatagtattattgggtgttttttttttaggtttttttggaaatttttgttttggaaatgtagaaagtttttttttttgtttttattttgaaattgtatttaataatggtaaataagttatttagttttttatagttggtaaagtgtaagttgtagatgttgttatatagtattttttgatagttttagggtagattgttgatttattttgtaggtaaaggagttgagatgtaaatattttttaaggaagtaagaatggtttttttttttattttttagaaggatttagggtaattgatttatttgataatattagggaatatgggttgttagttatgtatttatgagagaggtggttttgatttttagagtatggattttaggggagtttaggaatttgtaggagagggttttttagttggttattattgggatgggtatttgggtttgtgggagagggttttttaggtggttattattgggattggtatttgggtttatttggatgggttttgggagggtttgtttttgggggagatgttggtatgaatagttaaaagtattattttgagattttatgttaatattttttttttgaaatatgatatttgggaggattgtatagtttttttaatataggaaaatagttttgattgaaggtagttttttttttgttgtattttttgaaggtttttgggggttttgttattttgagttattttttatttgtttttgttgattttgtaaattggatatatttttaagggtttagaatagtatttggtataaaataggtgtttaaaaatatgtatgtaaaatagtggtttttggtggaggttgttagagttggttgtggttttatagagtaggaagaagtatgttttatttgtttgggttttggttagggtgttgagggttagtatggatattaggattagggtgtagattattttgttttttatggtggttattgttttttttttgttttaaaggtgattttgagttagggatgagaggttgtttgagttttggattttatagggtaggttttgtttgtttaaagagtgttagataatatttgtttaaggaggtttggggattttttgagataataatttttattgatttttattaaaggtgttttttagatatggttaagttatatggaaggatttgttgatagatagagatgatatgtggtgaggttattttggttgagggatttgagatttagaaagttttttttttttatgggagttttttttaatttgattttaatttaggttttatttatatttgagaggtttttttgttagggtaaatattgtatttattgtagaagtgatttatagtgagagatggttggaaaaaggtttggttgtgataatagtggtttatggggtggttattgtgattttgtagggggaagggaaggagtttatgaagtttattttgtttaggtttaagttaatttttttatagtggaattgttttaataatgaaattgtaggtttggtgtagtggtttatgtttgtaattttaatattttgggaggttaaagtaggtggattatttaaagttaggagtttgagattagtttggttaatatggtgaaattttgtttttataaaaaaaaaaaatataaaaattagttaggtatggtggtgggtgtttgtaattttagttattttggaggttaagttaggagaattatttgaatttgggaggtggaggttgtagtgagttgagattattttattgtattttagtttgagtgatagattaagtttttttttgggaggggttgggggtaggagggagaaaaaaatagtatatatgagttgttattaaaaattgataaagtgaatgtggtttatttttttgtgtttatggggtttttttttttttttttttatatttttttagttggttttttggatttttgtattttagaggatagttttttgtttttttgtattatgttttattttttttttttgtttggagtttttttttttatagtttttattattttttggtggataaaataagtgattgatatattatgttggttatttatttattgtatttttttttgtagtagatgggagggtgtatgggagtagaagtttttattttttagtgttttgaggtggttttagattttagaatagtggttttgattggtatttgagaaatagttgttgaagagttgtatgaagaaatggataataggagaaatttttttttttttagtgagaaattaggttttgaggaaaatgtatgttagtttaataaaggtattatttttttttgggtgatttagttagtatatttttgtagtttttttgggaggggagtttgggttagaatgggggtggttatgtttttttttgttttattttaggatttagttttttttttagggttgttatttttgtattggggtttttatttttgggttagggtttttaggaggggtttgattgtaggatttagggaggggttgaggtttggtgttttttgtggttagtttaagtttattgaaaataggatgggggtattaggtttagggtggtgtttatagtgatggtggtttttgttgttttaattttttggattaaaatgggggtttttggaaatgggatgtaaattgtataattatttggagaaaaggtgggtagtgtttggtgaggtttaagttatatagattttatagtttagtaaatttttttgtttttaggtttggttttttaattttagaaatatgtttatatttgggtagaagaaaatataggtaaagatattttttttagtattgtttgtaatagttggaaatagggaaagaaggaaggaaggaaaggagggaaagaaaagtaaaataaatatttattaattagggaaagggaaaatgaatttaaaatataatgtagttgttttttagtatttttgggggattggttttaggattttttatttagggatgttaaaatttataaatgtttaagtttttggtataaaatgatatagtgtgtagaaattatgtgtatttttttttatattttaattatttttaggttagttataatatttgatgtaatatttatattttattttattttgtagattttatatagtatttgatttgtggtatatttaagttttgatttttaagatgttgtaaataagattttaaaatattttttttttttgagatagagttttgttttgttgtttaggttggagtgtggtggtatgattttagtttattgtaatttttattttttaggtttaagtgatttttttgttttagttttttgagtagttgggattataggtatgtgttattatgtttagttaatttttgtgtttttagtagagatagggttttattatgttggttaggttggttttgaatttttgattttaggtgatgtatttgttttagttttttaaagtgttgggattataagtgtgagttattgtgtttagttggattttaaaatagttttgatttgatattattggaatttatggatgtagaatttatgaatatagagaattaattgtatatatgtattatattttatatatattatatatgtatgtatgtgagtattttttagaagatgaaaatgaataaataatgagaaatattgaaaataaagtgaagtgaaaaaatttgttaaaatggtttgtaaagtaggatattatttataatgtagatttttaaattatgtgaaataatgtgatatattgttggaattgtatttagatgaataaaatgatgatagtgtagataggaatgagatattgattttagtatgatgggtttgtttaggaaggaggaagtaggaaaaggtggtggggtagggtgtaaaggggtttttgatgtttttgtaatgtttttttttgttgaagaaaatttgagggaaataaggtaaaaaggttagtatttattaatgaggggtagtgtagatttatggatgttgttttagtattttgtatatgtttgtaattgtttttttggaaagtttagtttttatttttttgggagagttgtgagataattattaagtgttggagtttggttttttatattagggttggagtggttggagttgtttttgggattttttgttttttgggataagagttttatttttgtgagagtgggtggaatttaagattatattatatataattttatttataaaaatttgttgaagataattttagtgtggtgagggagagaatgtagaggtaagtgttagtttattattagtgggggattttgtgttagtatttttatagttttgggttttagtttttttatttgaaagatgtagtggttgggttataggatatttgaagattttgtattttagattttttttggtaggtatttatggttgtgggggtgtttgtggttgtgtaggtattgtttgttttttgtgtttagttgatttttttgtggtttggtgagagttttttatttttagtggggggttttgtagttgtttagattttttataagggggatgtgtagttggggagttagtttttttttgatgttttttatttgtttgttgtttttgatttgtgttttggtaggagggggttttgtaggtggttttggagggagggaggagtttgggaggaagtggatttgggtttttttttaggattttttttgggattatttgggataggttatgttttttttttagttatagtttaggtgggtgttttttttatatattattttttttaggttttagagtagattttttatttttttgttttagtttggggggtttattagttgtaaggagatttttatagtttttattttttttgtattgtttagatttgttgtggtgaagtttgttttttgttaggtttttggttaaaaaagtaattgttattttagggattttttataaggatatttagttgaggttttggggtt

SEQ ID NO: 766 - DNA, 7001 bp, Artificial Sequence
  chemically treated genomic DNA (Homo sapiens)
aattttagggttttagttgggtgtttttgtaaagggtttttggggtggtagttgtttttttgattagaggtttggtaggaaatgggttttattatagtggatttgggtaatgtgaggagagtgaagattgtaaaagtttttttgtggttggtaaattttttaggttggggtaggggggtgaggggtttgttttggggtttggggaagatggtgtgtggagaggatgtttatttgggttgtggttgagagggggatgtggtttgttttaggtgattttaggagggattttggaggagagtttggatttatttttttttaaatttttttttttttttagggttatttatagaatttttttttgttaaggtataggttaggggtagtgggtaggtggggagtgttaggaggagattgattttttaattgtgtgttttttttgtggggaatttgggtggttgtggggttttttattgaaaatgaggggtttttgttagattgtagggaggttggttgggtgtaggaaataagtaatgtttgtatagttatagatgtttttatggttatagatgtttgttggagagggtttgaggtgtggagtttttagatgttttgtggtttagttattgtgttttttagataagaaaattaagatttagagttgtgaaaatgttggtatagggttttttattgatgatggattggtgtttgtttttgtatttttttttttgttatattggaattgtttttaataagtttttatggataaggttatgtatggtgtggttttgggttttgtttatttttatagggataaagtttttgttttgagaaatggagagttttgggggtagttttagttgttttaattttaatgtgggaggttaaattttggtatttggtagttattttatagtttttttaaggagataggagttgggttttttaagaaagtaattgtaaatatgtatagaatgttagaataatatttgtgaatttatgttgttttttattaatggatgttaatttttttattttattttttttagattttttttaataaaagaaaatattatggagatattgaaggtttttttgtgttttattttgttatttttttttgtttttttttttttagatagatttattatgttgaagttagtgttttgtttttgtttatattgttattattttgtttatttggatgtagttttaatagtatattatattgttttatatagtttggaaatttatattataaatgatattttattttataaattattttaatggatttttttattttgttttgtttttaatattttttattatttatttatttttattttttgaaagatatttatatatatatatatataatatatgtaaagtataatatatgtatgtaattagttttttatatttatgggttttatatttatggattttagtaatgttagattaaaattgttttaaaatttagttgggtatagtggtttatatttgtaattttagtattttgggaggttgaggtgggtgtattatttgaggttaggagtttgagattagtttggttaatatggtgaagttttgtttttattaaaaatataaaaattagttgggtgtggtggtatatgtttgtaattttagttatttaggaggttgaggtaggagaattatttaaatttgggaggtggaggttgtagtaagttgagattatgttattgtattttagtttgggtgatagagtaagattttgttttaaaaaaaaaaagtattttaaaattttatttataatattttaaagattaaaatttgggtgtgttgtaagttaagtattatgtagaatttgtagaatgaaatgaggtgtaggtattgtattaggtattataattaatttagagatggttaaagtgtaggagaggatgtatgtggtttttgtgtattatgttattttatattagggatttgagtatttgtggattttggtatttttgggtggggggttttgaaattagttttttaggggtattaagggatgattgtattgtattttaagtttattttttttttttttggttaatgaatatttattttgttttttttttttttttttttttttttttttttttttttgtttttagttgttataaataatgttaaaaagaatatttttgtttgtgtttttttttgtttaagtatgaatatgtttttgggattaagagattaggtttggaaatagaagaatttgttgagttgtaaaatttgtatggtttaaattttattgaatattgtttattttttttttaaatgattgtgtaatttatattttatttttaagagtttttattttgatttgagaaattagagtagtgaaaattattgttattatgagtattattttgggtttggtgtttttgttttgtttttaataaatttaagttgattatagaggatattaggttttggtttttttttgggttttgtggttaggttttttttggagattttggtttaggagtggagattttggtgtaggagtggtagttttggaggaggggttgggttttgggatggagtgaagaggaatatggttgtttttattttggtttaggttttttttttagaggggttgtagaaatgtattgattaggttatttaagaaaagatagtatttttgttaggttagtatgtattttttttagggtttaattttttattgaagaagaaaagattttttttgttgtttatttttttatgtagttttttaatagttgttttttgaatgttaattaaagttattgttttagggtttggggttattttaaggtattaggagatgaggatttttgtttttatgtgtttttttgtttgttgtagggaggagtgtaatgaataaataattaatataatgtgttagttatttgttttatttattaggaggtaataagagttatgaaagagaaagttttgagtaggggaggggagtgaggtatggtataggagagtaggaggttgttttttaaaatataggagtttaggggattaattgggaaggtgtgggagggggagggagggagttttatagatataggggagtgaattatgtttattttgttagtttttgatggtagtttgtatatattattttttttttttttttgtttttagttttttttagaaggagatttaatttgttgtttaggttggagtgtagtagggtgattttgatttattgtaatttttgttttttaggtttaagtgatttttttgatttaatttttagagtagttaggattataggtatttgttattatgtttggttaatttttgtattttttttttttgtagagatggggttttgttatgttggttaggttagttttaaatttttgattttaagtgatttgtttgttttggttttttaaagtgttgggattataggtgtgagttattgtgttaggtttataattttattattaaaataattttattgtaaaagaattagtttaggtttagatggaatgggttttatgagtttttttttttttttttgtaaggttatggtggttattttgtgagttattgttgttatggttaagtttttttttggttattttttattatgaattatttttgtagtgagtatagtatttattttggtgggagggttttttagatatgagtaggatttggattaaggttaggttggaggagatttttatgggaaagagggattttttgaattttagattttttagttaagatgattttattatatgttgtttttgtttattagtaaatttttttatgtagtttgattatgtttaggaaatatttttgataaaaattagtggagattattgttttagaggatttttgggtttttttaggtaaatgttatttaatgttttttaagtaaatagagtttgttttataaaatttggggtttgggtggttttttatttttgatttggggttgtttttggagtagagaggaggtaatggttattatggagaataaggtgatttgtgttttggttttggtgtttatgttggtttttggtattttggttgaggtttagataggtaaggtgtgtttttttttgttttgtggggttatagttagttttggtagtttttgttaggagttattgttttatatatatatttttgagtatttgttttgtgttaggtgttgttttaggtttttaaaagtatatttaatttataggattggtaaaagtaggtggagagtaatttagggtggtagggtttttggagatttttgagaagtgtgatgaggagggggttgtttttagttggggttgtttttttgtgttaggaagattatataatttttttaagtgttatgttttaaagaggaagtgttggtgtggggttttagaatagtgtttttgattgtttatgttaatattttttttaggggtagatttttttaaggtttatttagataggtttaaatgttggttttagtgatggttatttgggagatttttttttataggtttgaatgtttgttttagtggtggttaattgggagatttttttttataggtttttgggtttttttgggatttatgttttgggagttaaagttattttttttatgagtgtgtggttggtaatttatattttttggtgttgttaagtggattggttgttttgggtttttttagggagtggaggaggaggttatttttgtttttttgggaagtgtttgtattttaatttttttatttgtagaatggattaatggtttgttttagggttgttaggaaatgttgtgtggtagtatttgtgatttgtattttgttagttgtggggagttgaataatttatttgttgttattaggtatagttttaaggtgggggtaggagaaagggttttttatgtttttaaagtaagggtttttagagaggtttgaagagggagtgtttagtggtgttgtttgtgtttttattgttttttagttattttttgatttttgttgtggggtattgggtttgaggggtgggtttgggtagtgtagaagagtagttagtattgggttgtagtgggaagatttttaagtttatggtagggagtgggggagttttggaatttgagagaggaagtggttttggtgtatagaatgaattgggtgggtttttgtgttggttatttttaggtttatttgtttgtgtttttgtttttattttagtttttagttttgttttttgtgttgtgggattatagaggttgtggtaaatttttttttttattttatatattttttggtttaaggtttagagtgtttttgtgggttatttaggtttatgattttgttataattgaaatttagaaaattgtgattatagtttagtgtatttgtgtgtggaaattatttttatttatttttattatgtgataaagataaagtgggtgggtaagatagagtttgttggaggtagagtattggggttggaaatttttttttttgaggaggaaatttttttgatttttaggatgatgatttttttttattatggggttttttttgatttttatagtgttttgggggtgggtgatgattatttttatgttgtgatggatttagattttaggagggtaaggtttttatggaagttgttgggtagtgggagttgaatatggattttttttagtaagttaggaatattttttttaaagatattttgaggtagtttttgatagtaaagtagataagagaatagttttttttggttttttttggggtgtttttatttgagttagtgtggttagattgagtttttttttttttatgttttaaggtagggatagggattggagggtgttttgggttttttttttattttttgttgtaggttgttaattattagattttaataggttgttttttgagatttttgattttgtggagtttagagtttgaagttttggtgttagaattttttgtataagattttgtggtagtttttagttagttttatttgtttatgtgttttttttttttagatttttttttttattgttttgttttaagttgttttatagtttgtattttttgttggttttttttagattattttatttggtttttttattttatttgtaatgggtttttattttttgaatatatttgggtttttggaatggtttttgtttatgtggttttatttttatttggtgaatttttttttgtagggagtttttttgttttgtttaatttgtttgttattggtttttttggggagtgttttatttttgtggttattttgggtattttgggatgatggttttgtgttgttttgtatatgtttttgttttttttttttattagatttttagatttttttttttttttttttgagatggagttttgttttgttatttaggttggagtgtaatggtgtgattttggtttattataatttttgttttttgggtttaagtgatttttttgttttagttttttaagtagttgggattatagatgtgtgttataatgtttgtttaattttttgtatttttagtagagatggggttttattattttggttaggttggttttgaatttttgattttaagtgatttattttttttagttttttaaagtgttgggattataggtatgagtttgggtttagatatttagatttttattaatgatttttttggttttaatttttgggttttttttatttggtatagtgtttggtttttgttatgttagtttttattttttatgtatataaatggtgtttagtaaatatttatgtattgagtaaaatttaataattatttgttgaaattaaaaagtgaataaataagttatttagaaagatgtaaagtttataaatttggggtattttgtattttttttgagtgtaatgtttgtatattaggatgtgaggattatgttttttttttatgttttgagggttttatatttgttttattggatagttgttgatgttat

SEQ ID NO: 767 - DNA, 6001 bp, Artificial Sequence
  chemically treated genomic DNA (Homo sapiens)
gggtatagtgtgaggaagaaatatggaaaagatagattttttttagattgaaaaggagattgtttaggggtgggaggaagataaatagaggttagtgggttttgaggttgattgtatgtgtgatttgtgtttttgaaatattattttggaaattgtaggatttttgggaggaatggttgtaggggatgttttagtagatgagataatagttattgttattttattttaaatttttgtgtttttagtgggatatagaagtagtaggttgtttattaatttaagtagttatattagtttgggtagtggaaataatttagttatattttttgggaatagaggattaaatggatgtgttgtttttttttttaatttattatatgggattgtgtatagttttggtgttaggaattaattttaggaaggatgaaggttgatttttttagtttttagtagataagttgttaggggtagttattaatatataataattgagttatttatgtaaaataatggatatgtgatgttttttgtatgtttgagtttttgggttgagatttattttgttttgaatgttgtggtttttttaatgaagttgttgaggaatgtaggggttttgtttattttgtttttttttggaaattttgttttttaatttttagatttagagtagtgtttttgtttttagttttatattgtttatatttttattaggaaaagtaaataaaagttaaagttttgtttagttataagttttttttaaatggggtagttggattgtatatatttttggtgtattaattttatttagatagggaaaatatttttatattaaaagaaattaggttaaattatggtagagaatgtaaaatttatagtttaaaaatgatgaaattttagattttaaaggaattttttttttgtagggtagggggagggtattttgttttagaattttatgtgggtttttattggagtttttttgagaaggatatttttgtggaaaagtttgagtagttttggttttgtgtttggtttggttaggggttatttttttttggtttgggttgtagtgttttatgggtattgtgtttttgttaatatttttttatgtttttaaatttatagtttgttagtgtgggtgtaatttgagagttgttgtaggtttttagtttatttgttttttaaaggaggaaatggagaattagtgattttaaaggatttgtttggtgggtatttatgttttttaggttattgtttttttttgtgtttttggttatttttgttttttaattttgtaggaatttaggatttatgtgtaaatataaagaattgtatttatttatttttggtttttttttattttgtgtttttaattttgggggggttttttttttttattggggtatttgatgtttgtggggggtgtttagaaaagtttggtagattagtgattggtggttttggaataaatatattatagtttaaattgggggttggtggtggagaggtgggtggatgggggttataaatttgtttggtaattgtttttttagttaagagagaggagttgaggttttttggggttggaggattggaattggttagattgtgggtttaaggggtgaaggtaggttggtaggggtagtttttttttgttgtttataatttttgggtgggtgtgtagttgagttggtttggttggttggtgtaattttgtgtgttttttgtattgattaaaaatgggggttgaaatagtaaatgtgaggaggagtaattgttttgatttggtttagaagtgtgattaatggggatgtgagtttttttgtgtgaattaattagtgtagggtttgtgatagtatgggttaatggggtgttgatttggtgtaggaataaggtgggggtttggggttggttgtagatttttattgtagtggttaggaatgttagttgtttatgtgtttggttttttttggttgatttattgttttggttgttgtattatggatgtttttaggtaggtggttaattttgggtttggttttgttaagttgttgtatttagtaagtttttgtgagtgggtgttgggagtgaggtttaggtgggagtatgtatgtgggtgggtttgtatttttgtgtgtggtagttggatttttgttttttgttttgagttttttaggtgttttgtattagtgtgtatagtgggattagtagttttggtaagtgggttttgggaagaatgtagttggtgaggaagtttggtgaggtgtgtttgtgtagttgtttttggttttgattgttggtgtgaggtagtgtatgatttagttggttggggtttgttgttttgttggtgttatgtatttgtagatgtttgggttgtgttattttttgggttggtttgggggttggggtggggtgaaaaagaaaaagttttgatttttgtttttgttttgtgtagttgtgtggtgagtttgggtagtgtggagtggatgtatgaatggatatagtgtgaatgagtgatgaatgggaatgaattgatgataggttttgtatatgtagtggattatgttagttgaaagggattgtaaatttaaaggtttgtgtgtgtgtgtttttttatgttttatattagtgtttgttttagttagtatttaggaatattgttttttagaaatgtaaatttgaaaatttttagtttagtttttttttttttgttttttatagaatttatttttttttaaagtttttttttttattttttttttttttttaatttgtttgttttttaaaggtgtttgagtattttaattttggtagattttgggttgtttaatttaattttttgtttattttgttttggagtaaattgagtgattgaatttttttttgggttataattagattttgttggtggaatttattttttgtttttttaggttttagtttggtttttttttttttttgttaaatttattgtttttagttttatttgtagtgaagaaggtaaagtttttgatgtgttttgagtttattgttaggtggttgttgttgttgttagatttttatttttttaattaggatagagttgataatatgttggagtagtatgaggtatagttaagtattttataattattaattgttgagtagagtagaaatttttttgggatagagttttttttgtgttgtggtaagaatagagaatttaattttaaaggggaaaggattttttatttttttaggggtagtgtttatagtagttgagaggatagggtttatttttttttagtggttatagtttattttaggtgagattttttgttttagttgtggagatgttttttgtagtttttttttgtattttttatgttttggagtgtttttaatgtttgttttttatgtattttgttattaatttattattataattgtaatggtaattgttattagtaatataattatttgttattaatttttttgggaggatttttgtttttggattgtatgtaatttggggggtaggagggtgagggggtaggtagatgttgttttttatgtatttttttgatttagttgaattgtaaatattagagaagtttttaaattttttttgattgtaatttatagtgaaaaatatgtttataaaatgataaagtatatatatttaattgtaataaaaataaatgttttatgaaatgatgtgtagtttaattatttgtgatatatattattttgtattttattttgttttagtttgttttgttttattaaaaaaattagttgtgagttgggtgtggtggtgtatgtttgtaatttaagtaatttaggaggttaaggtgggaggattttttgagtttaggagtttgaggttgtagtgaattgtgattgttttattgtattttaggttgggtgatagagtaagattttgttttttaataaaaaaaaaaaaaaaaaaaaaaaaaaaattggttatgatttataaaagtaatgtattttttaattggaaaaaaaaaaatttattggattagggaggtgtgattttttagtaggagtttttaaaattgtttgtaattattttggttataaatttttatagaattatttttaatgaatgttgtttataagaaagatatagttttaggagtaagtttaaagattatttatagatgaatgtttttttttattaaaagaaaagatttattttattttatttgattagttggtgttaataagtatttaatattttagaaaataataatatatttttagatttagttgttaaggtagttttttttttaatttaatttttttttttttttttttttgagagaagttaagttttgttatgaggttggagtgtagttgtttggttttggtttattgaaatttttgttttttgggttttagtgatttttttgtttttgttttttgagtaattgggattataggtatttattattaagtttagttaatttttgtatttttagtagagatggggttttattatgttggttaagatggttttaattttttgattttatgatttgtttgttttggttttttaaagtgttgggattataggtgtgagttattatgtttggttttgtttaattttttattgttaaaatattgttttttgagataagttgtaatttagtttaggttatagttgtgttttaatgatgttttttttagtaagtattttaaaaaaaaaggtgttttttatttgtagattttttttggttggttgtttttgtatttattttgtgtttatttttaaagtttttttttttttttttattttttattaagggaatttttatatatataaagataaaagtagtgtaatgaatttttaaggatttatttttgagatttaataattattaatattgtgttagttttgttgtagtattttgggatgaattttatttatagtaggtttttttttttttttgtttattttatgttttttagtttagtattttagattaaaagagattggaaaattgagttatttgtataatttgggtataatttttttattgttgtttttttaatttagaattttatgtattttttattttagttttaggagagtggtgaatgagatttgtgaaggggatattttttagggaattggtaaatttgggtttttggaaaaagtgtattaatattagttatattgtttaattttatgtttattttgtgtgtaagttgtataattgttggttttgtggatatgggaaggaaggagattggttgtgggtggggatggaagtttggggattttattgtagatttttttttgtttttttgttaggtttgtatgtttagagggaaagtagtgtagaatatatttaaataattttatttttttttatttttttttaggtgttgttagagatataaaaggaattattagattataaaggagttggtattagtgtttttggtaagatttatttttgaattttgtgaatgtttatgttttaaaggaagtttttttttttttttttttttttagaggtagggttttgttttgttatttaggttggagtatagtggtgtgattatagtttattgtagtttttaatttttgggtttaagtgatttttttgttttagtattttgagtagttaggattataggtatatattattatatttggttaattttttttaaatgtttaaaatattttttaaagattttatgagatgggattttattttgttgtttaggttgatttgaaatttgtggtttgaagttatttttttatattggttttttaaagttttgggattataggtttgagttattgagttttggtttaaagggaattaatttaaatgtattaaatatagaattatagggtttatagggtttttttataggtttttatagatatatttttaaattttaatagtttgggttgtatgtttgatagaaattattttgaaaatagtataaatgttggtgagaggttttgatattttagtttatt

SEQ ID NO: 768 - DNA, 6001 bp, Artificial Sequence
  chemically treated genomic DNA (Homo sapiens)
ggtaagttgagatgttagaattttttattagtatttatgttatttttaaaatggtttttattagatatgtaatttaagttattaaagtttaaaaatgtatttataaaggtttataggaagattttataggttttgtaattttatatttgatgtatttaaattagttttttttgggttagggtttagtggtttaagtttgtaattttaaaattttgggaggttaatgtgggaggatggttttaggttatgagttttagattagtttgggtaataaagtgagattttattttatgggatttttaaaaaatgttttaaatatttaaaaaaaattagttaggtgtggtgatgtgtatttatagttttagttatttaggatgttgaggtaggagggttatttgagtttaggagttggaggttgtagtgaattatgattatgttattgtattttagtttgggtgatagagtaggattttgtttttaaaaaaaaaaaaaaaaaaaaaagttttttttgaaatatggatatttatagaatttaaaagtaaattttattaagaatattaatgttaatttttttgtagtttaataattttttttgtatttttaataatatttagaaaaaaataaaggaaaatagggttatttaaatatgttttgtattgttttttttttgaatatataaatttgatgaggggataaggaagggtttatagtgaggtttttaggtttttatttttatttatagttagttttttttttttttatgtttataaagttagtgattatgtaatttatatataaggtaagtatgaaattaggtaatgtgattgatgttgatatattttttttaaaggtttgaatttattgattttttagaaaatgttttttttataaattttatttattatttttttaaagttaaagtaaagaatgtataaagttttgggttaaagggataatgataaaaaaattatgtttagattatataggtaatttaattttttgattttttttggtttaaggtgttagattgggaagtgtggggtgggtaggaagaaggaagagtttgttgtgaataagatttgttttagggtgttgtaataagattggtataatgttgataattgttgagttttagagatgggtttttggaggtttattatattatttttatttttgtgtatgtgaggatttttttaataaaaaataaagagaaaaagaaaagttttaaaaatgaatataaaataagtgtaaaagtaattagttagagaaggtttatagataggaggtatttttttttttaagatgtttgttaaggagggtattattaaaatatagttataatttaaattggattgtaatttgttttaaaaaatagtattttaataataaagaattagataaggttgggtgtggtggtttatgtttgtaattttagtattttgggaggttaaggtgggtagattatgaggttaagagattgagattattttggttaatatggtgaaattttgtttttattaaaaatataaaaattagttgggtttggtggtgggtgtttgtaattttagttatttaggaggtggaggtagaagaattgttggaatttgggaggtggaggttttagtgagttgagattaagtgattgtattttagttttgtgatagagtttgattttttttaaaaaaaaaaaaaaaaaagaattagattaaaaaaaagattgttttgatgattgggtttaagaatgtgttattgttttttgaaatgttggatgtttgttagtattagttgattaaataaaatagagtgaatttttttttttagtaaagagaaatatttatttgtgaataatttttgaatttgtttttgagattgtattttttttatagatagtatttattgaaaatagttttataaaagtttataattaaaataattataaatagttttaaagatttttattgaaaaattatatttttttaatttagtaggtttttttttttttagttgaagaatgtattgtttttgtggattataattaattttttttttttttttttttttttttttgttaagagatagggttttgttttattatttagtttggaatgtagtgggataattatagtttattatagttttaaatttttgggtttaagagatttttttattttagttttttgagttgtttggattataggtgtgtgttattatatttagtttatgattaatttttttaatgaaatagaatagattagagtaggatagaatataaaatagtgtatgttataggtaattaggttatatattattttataaggtatttatttttgttataattgaatgtgtatattttgttattttgtaaatatgttttttattgtaggttatagttaaaagaagtttgaaagtttttttaatatttataatttaattaaattaaggaaatatataaaaagtaatatttgtttgtttttttatttttttgttttttaggttatatgtagtttaagggtaaaaatttttttagaaaaattaataataaataattgtattattgatgataattgttattataattatagtaataaattaataatgaaatatatagggaataaatgttgggaatattttaaaatatggggggtgtaggaggaggttataggaaatatttttatagttggagtagggaattttgtttaaaatgaattgtaattattgagaaaaaataagttttgtttttttagttattgtgagtgttgtttttagaaaagtaagaagtttttttttttttaaaattggattttttgtttttattataatatagaggaggttttgttttagggagatttttattttgtttaataattgataattgtaaaatatttggttatgttttatgttgttttaatatattattagttttattttggttagaaaaataaaaatttaatggtggtggtagttgtttgataatgggtttaaggtatattggagattttgttttttttattgtgggtggggttggggatggtgggtttggtgggggaggggaggagttgggttggggtttgggaaggtagagagtgagttttattagtaagatttgattgtggtttgggagagaatttaattatttggtttattttagaatgaaatgaatagggaattgggttaagtagtttaaagtttattagagttagaatatttgaatgtttttaggggataagtaggttaaaaaaaggaggggggtggggagaaaggttttaggaaagggtaggttttatgggggataaggaggggaaagttggattgaaggtttttaaatttatatttttgaaaagtagtgtttttaagtgttggttaaagtaaatattggtgtaaggtgtaggggggtatgtatatgtggatttttaagtttgtaattttttttagttaatgtgatttattgtatatgtaaaatttgttattggtttatttttgtttattatttatttatattatgtttatttatgtatttgttttatattgtttgggtttgttgtatagttgtgtgaggtgaaggtagagattagagtttttttttttttgttttgttttagtttttggattggtttaggagatggtatagtttgggtgtttgtaggtgtgtggtattggtgggatagtaggttttggttagttgagttgtgtattgttttgtattagtagttagggttaggggtagttgtatgggtatgttttgttgagtttttttattaattgtattttttttgaagtttgtttgttggagttgttgattttgttgtgtatgttgatgtaaagtgtttaggggatttaaggtagggagtgggaatttgattgttatatgtagggatgtaaatttatttgtgtgtgtgtttttgtttgaattttatttttggtgtttgtttgtggggatttattgagtgtggtagtttggtgggattaggtttaaagttgattatttgtttgggggtgtttatggtgtggtggttagggtggtgagttagttaaggaggattgaatgtgtgaatggttggtgtttttggttgttgtggtgagagtttgtagttggttttgaatttttgttttgtttttgtgttgagttggtgttttattggtttgtgttgttgtaggttttgtgttaattggtttgtgtgaaggagtttatatttttattggttgtgtttttgagttgagttgaagtagttgtttttttttgtgtttattgttttaatttttatttttgattaatgtaaggagtgtgtgagattgtgttagttagttgagttggtttggttgtgtgtttgtttgaggattgtgggtggtgggaagaggttgtttttgttaatttgtttttgttttttgagtttgtaatttggttggttttagttttttaattttagaggattttagttttttttttttggttgaaagggtagttgttgagtagatttgtagtttttatttatttatttttttattattagtttttagtttgggttgtgatgtatttgttttagaattattagttattaatttattaaatttttttaagtattttttatgggtgttagatattttagtggagagagaggatttttttaaggttggaagtgtaggatgaagaagggttgggggtgggtggatatggttttttgtatttgtatgtgggttttgagtttttgtaggattaaagaatggaggtggttaaggatgtagggaggagtgatagtttgggaagtgtggatgtttgttaggtaagttttttaaagttgttgattttttatttttttttttgggaaatgagtgagttggaaatttgtgatagtttttaggttgtgtttgtgttgataagttgtgagtttagaaatgtgaggagatattaataagaatgtgatatttatagggtgttgtagtttaaattagaagaaggtggtttttagttaggttaggtgtagggttagagttgtttaaatttttttatagaagtgttttttttaaaagaattttagtggagatttgtatggggttttgaaatagaatattttttttttattttgtaagaaagaagtttttttgaagtttggaattttattatttttaaattgtgaattttgtattttttattataatttaatttagttttttttaatgtaaaaatattttttttgtttgagtaaaattgatgtgttaggaatatatatagtttaattgttttgtttagagaaggtttgtaattggataggattttggtttttgtttgttttttttaatgagaatgtgggtggtatggggttgagagtagaggtattgttttggatttgggaattggaggataaagtttttagaaaaaggtaaaatgaataaggtttttgtgttttttagtaattttattaagaaaattgtgatatttaagatagaataaattttagtttagaaatttaggtatgtaagaagtattatatatttattattttatgtaaataatttagttattatatattagtagttgtttttagtagtttatttattggagattaagggagttagtttttattttttttggagttagtttttaatattagggttatatatagttttatgtagtgggttgggagaagggatagtatatttatttggttttttgtttttaaaagatatggttgagttgtttttattgtttaagttgatgtggttgtttgggttgatgagtaatttattatttttgtattttattaggggtataggaatttggggtggggtggtggtggttattgttttatttgttaagatattttttgtagttattttttttgggggttttgtagtttttaagatggtattttagggatataagttatatatatagttagttttaggatttattgatttttgtttgttttttttttgtttttgggtaattttttttttagtttagagaaaatttgttttttttatgttttttttttatattgtgttt

SEQ ID NO: 769 - DNA, 4784 bp, Artificial Sequence
  chemically treated genomic DNA (Homo sapiens)
tttggttgtattgggatttatagagttatattttggagggttttttttttgatattgataagggtgtgtattatattttagtgagtgttatatggttgggggttaatgggagttatattttttagatttttagtgtgttttttattgaggtttattttgaagattatagtgagttgtagttggtgaggatagtttttttagattttggtgaggtggtattatttgtttgtgttgtggatgaatttgtgattgttttgatggtgattttggatgttgattttattaagatgattttaaagtaaaggattgattttttgtataggatgtggagttttttagaagtagagttttataatatgaaattagtgttggtggtgaataatagattatttgatatgttggtttttatggttggtttgggaaatgtaaaaaaggtggtggagaatggggttttttttttttggaagttgggttgttttttgaattagaatagtgtgtttgatatttatggtgtagaggtttttgttagggagggtgtaatgtttgtttagtttggttattttgtggtgggttggtatattgttaataagaagttttttttttttaaatgtgtttggaggtagatttatgttatatttatatttgttattgttattgggtttttaattatggttatttaggagtttttatttaggattgtgttaatttttatatttttagttattgtttttttaatagagattatggtttttttagttagggattttgtttttgggaaatttatggttattatttggatttgaggtgttattatttaaattttaattttaggttttatttagtttatttgggtgttagaagttggtattatagtttttggttagatttgtttaatgatgattatttttggttatgtggagtttattgtagttgttattttttttataattattattaagaagttatgagtatttatattaaaattagtaatgtttttaattgattttattattattatgatttgtaggttaattaagaaattatggatattttggttagtgttttgggttattattaaagtttttattattagattggaaattgttttattgtttatttgtatttgtattattattagtggagtgttttgtggtggagaatttaattagtgtttagagtttaagaattatattgatagggtagatgtttgggttggtatttattttgaggtgaagattttgttagatattttttatgattatgaggatattattattgataagttgaagttgattttgaaattgtgggagtagtagttggtgggtgagaagttttgggtatagtttaatagtaatagttagtttatgtatggtttttttgatagtagttatgtgggtaaatatgagtattttatgtatgttatagataaggggggtttgttggttgtggatgtttttgagatttatgtttataggtgtttttaaggggatagggtttttgtaaggtttaaggttaagtttgtgggtgatttggtattggtgttgaatgatatttataagaagattgttttggtaaagaaattggtttttgtttttggagattgaaattgtagtattattattttgtagaatattatttggggttttattgtggtggaatggattaataatatattgtttttggagttttgttttaaggagtagattgttgggttgagttgttggattgttgaggatgatggaaaattttggtttgttttttttaatgttttagagtttgattttaaggttataagtattattgtgatgggttttggtagttgttggtatttatagtttatttttgtggtattatttaggagagtgtttttagaggtgttgtttatagaagtgtttgatagggattttgagaagagtagtgaggatgatgtttatttgtatatagttattttggttgtggtggttgtagttattttgtttattgttggtattattgttatgatttgttattgtaagaagtggaagggtaagtttatttttgaggattaggttatttttattaagaagggggtgtttattatttttgtagatgaattggatgattttaagtttttatttttttttagtatgttatttattttgtaggaggagaaggtttttttatttttttttgagtattttaattagagtgtgtttgagattatttttttgaattaggatattatgggagagtatatgtttttgtgggatgaggattttaatgtgtttttttattagtttttattgttttttatagtatttatggagggtaagggtttttgttttaagaatatgattttatattggttattttttttttatgttttattttaatttgtaagtgtttgggtggaggtagggtagggtaggggtttggagatgatatggtgttgtttgtggagattggtggtttgtagattattgtttattgggagttgatatttgatttagtatatattgatataggggtttggataagtttgttttttttggtttttttaaattttaaagtagttggagagattttggggatttttttatttttattttttgtttaatagtttttggtttgtttatagagaattttttgttttatttttgatggttggttttgaaagtattatgtggagtggaggtggagggagtgaggaattatgaatgaatttgtaggtagtgttgggtggttttttggttttttgtgttttgtttttaatattaattgtattgttttttttatttatgtgtgtttagttgtaggatgtaatatggaaaatagtaattaaagattaaatttaaaggatttttagaagttaaggttaagtttttatgtttaatttgttgtttatttaaatttgtatgtataatttttgggtgggtatggggaattgttttgttaaaaataagtttttagggtgttttaaatttagagaagattaagggatagtattttttattaaaggaatattatttttttatattatgttaatttggttgttttgatattttagagtttgattgggggttttttggttttggtttatgttaagtttttggtgttgggtttgtttttttgttgttgttaggggttggaagttggaggggttttttgggttatggatatttttatttttagtttatgtatattagtggtttatgattaaggggtttttatttttatgaaaaagggattttaagaggtagtggtggttgtggtttttaattttggtgttttagggtgggttagttgtttgtgggggtatttgggaggttaaaggtttttattatattaatttattttgttttattttttttttgtgtattgtttttttttttttttttaaaaggaatattatggttttttgaaatatttagtgggggatattttggtgaagatgtaatatttttatgttatgtgatgttttttttttatttgattttggttgttttgttttaatagtttatagttttgttttgatttattttattttttttttttggtattttagttttaggttttgggtttgaattattggaaaaggtttggtggttggggaggagtgttagtaatagtttataataaaaatttgttagtttttaaagttaattttttattaaagtttttatatagttttaaattgttttattaaaaaaaagatttaaaatggtgatgtttatagtagtttgtatgagtttttaagtgttgattttatggaattgatggttttgtttgttttgatttttttttttttattttttttaatggtttaaattttggaattatattggggtttttttgttttttttagtagaatatttgtttgtttatttgtatttttgttttatgatttaggggtgtttattttgttttgattttttttttgtggaagaaattattttgagtatgattttttttgatgtttgaagtgttattttgggtattttttagggaggaatgttttttgtaataatgtatttattttttgattgagggtgggtgggtggatttaggttttttttgtatatagagtagttatttttaagttatattgattgttttgtagaggatttgtgtgtgttgttttaggaggggagggttggtaggagggggggagaggtttttgttttattgttttttagagggtatttttttttgtgtttttttttatagggtttagttttttttttttgttttagtttttagggggtattttggagtgagtagtgtttttgtgggggagtttgtaaatgtgggtttagtggattattggtgattgggtttatgtttttaagttagagtttttttggtgttttagagataggagtataagtgggatttgatttggtgagattatttttgatgattttattaaaaaataaataatttttaatgttttaggtgagggttttgaaaggttttttaaatagttttgttgtttttagtaattttattattgggtattgttatgtagagatgtggttggtttagaatggtttgttgttatagtaattggaggtgatggggtagtgaatagaataataatagtaataatgtttttgtaggtagtttgtttttttgagtgttgggttggtgatggttgttggattttgtgagatggagagttaattttatatttaagtgtttattaattattgatgtgtttttatttttttttatatgattttaagatgtgttttttgtattttgtaaagaaatatattaaattaaataaaagtagtgtttttatt

SEQ ID NO: 770 - DNA, 4784 bp, Artificial Sequence
  chemically treated genomic DNA (Homo sapiens)
aataaagatattgtttttatttagtttgatatgtttttttatagaatgtagaaaatatattttaaaattatatagaaggaaataaaaatatattagtggttggtgaatatttgaatgtgagattggttttttattttatagagtttaatgattattattagtttagtgtttaggggagtaggttgtttgtaaaggtattgttgttgttgttattttgtttattgttttattgtttttagttgttatggtaataggttattttgggttagttatgtttttgtatggtagtgtttaatggtggagttgttaggggtgatggagttgtttggaaggttttttaaagtttttatttggaatattgggaattgtttattttttgatgaggttattagaaataattttattaggttagattttatttgtgtttttgtttttggggtattagggaaattttgatttggaggtatgagtttagttattagtggtttattgagtttgtatttataggtttttttataggggtattgtttattttagagtattttttggggattggggtaggggagaggggttgggttttgtgggagaaggtgtaaggggaaatgttttttggagagtagtaggatagagattttttttttttttttattagttttttttttttgaggtagtatatataaattttttgtaaaatagttgatatggtttagaagtagttgttttgtgtgtaaagggagtttgggtttatttatttatttttaattagggaatggatatattattgtgaaaggtatttttttttaaaaagtatttaaaataatgttttagatattaagaaaagttatgtttaaaatggttttttttataggaggagaattgaagtagagtgggtgtttttgagttatgggatagagatgtagatggatggatggatgttttgttaaaaaaggtaaaagaattttagtgtaattttagaatttaaattattaggaaaagtagggggaaaagaattaaaataagtaaagttgttagttttatggaattaatatttaagagtttgtataaattgttgtaagtattattattttaaattttttttttaataaaataatttgaggttgtataaaaattttagtaaaaaattagttttgagagttaatagatttttattatgaattattgttggtatttttttttagttgttagattttttttagtagtttaggtttaaggtttgggattggagtgttagagaaaagggatggggtgggttggggtaggattgtggattgttaggataaagtggttaaggttaagtgaggaaagagtattatatgatataaaaatattgtatttttattaaaatgttttttattgagtgttttaaaaaattgtgatattttttttaggaggaaaaaaaaaaataatgtatagaaaaagggtaaaataaaataggttgatgtggtggagatttttgattttttaggtgtttttataagtagttggtttattttggagtattaaagttgggggttatagttattattgttttttggagttttttttttatggaaatgaagattttttggttgtgggttattagtgtatatgggttggaagtggggatgtttatggtttaagagatttttttagtttttagtttttggtaatagtgggagagtaaatttagtattagggatttggtgtgagttagggttgggaggtttttaattaggttttggggtattagagtaattaagttgatgtagtgtgaaaaaatagtatttttttgataaaaaatattgttttttggttttttttaagtttgaaatattttgggagtttatttttagtaaagtaattttttatatttatttaaaaattatatatataagtttaggtaaatagtagattaaatgtaaaaatttaattttaatttttgaaagttttttgaatttaatttttagttattgttttttatgttatattttgtagttagatatatgtgaatagaaaaaatagtatagttagtgttaaaggtaaaatgtagagagttagggggttgtttggtattgtttgtgagtttatttatggttttttgttttttttatttttattttatatggtgtttttagagttagttattaaaaatgaagtgaagaattttttatgaataaattaaaagttgttaggtaaaaaataaaaataaaaaagtttttaaagtttttttagttgttttggggtttgggaggattagagagggtgggtttgtttaggtttttgtgttagtgtgtgttaggttaggtgttggtttttggtgggtaatggtttgtaggttattggtttttatagataatattatgttgtttttaggtttttgttttattttgtttttatttaggtgtttgtgggttaaggtgggatatagggaggaggtgattggtatggggttatgtttttgggatgggagtttttgttttttatgggtgttgtgaagggtggtgggggttggtagggaggtgtattgggatttttattttgtaggggtgtgtatttttttatggtgttttggtttagaggagtggttttgggtatattttggttggggtatttaggagggggtaggggagttttttttttttgtagaatgagtggtatgttggaggagggtgggggtttggagttgtttagtttgtttgtaaagatgataggtattttttttttgatgaaggtggtttggtttttaagggtaagtttgtttttttgttttttgtggtagtagattatggtaatgatgttagtaatgagtaggatggttgtgattattatggttggaatgattgtgtgtaggtagatattatttttattgttttttttagggtttttgttaggtatttttgtgggtggtgtttttgagggtatttttttgggtggtattatagggataaattgtaggtgttgataattgttagagtttgttatagtgatgtttgtggttttaaagttaggttttagggtgttggagaaggtaggttgaggttttttattatttttagtgatttggtggtttagtttagtgatttgttttttggggtagggttttaagggtagtgtgttgttggtttattttattatgatggagttttgggtgatattttgtagggtgatggtgttatagttttggtttttaaaggtgaaggttagtttttttattaaggtaatttttttgtggatgttatttaatattagtgttgggttatttataaatttggttttgaattttgtaggagttttatttttttgggggtgtttgtggatgtggattttgaaggtatttatagttgataggttttttttgtttgtggtatgtatgaaatatttgtgtttgtttatgtggttgttgttgggaaggttatatatgagttggttgttgttgttgaattgtatttaggattttttgtttattagttgttgtttttgtagttttagggttagttttagtttgttagtggtggtgtttttatggttatagaaagtgtttgatgggatttttattttaaagtaggtgttaatttaggtatttattttgttaatatggtttttgagttttgggtgttggttgggttttttgttatggggtattttattggtggtggtgtgaatatgagtaggtggtgaggtagtttttaatttggtgatggaaattttggtggtgatttggggtattggttggggtgtttgtggttttttggttggtttgtgagttgtggtggtggtggagttagttgaaggtgttgttggttttggtgtggatatttgtggttttttggtggtggttgtgggaggggtagtaattgtagtaggttttatatagttaggaatggttattgttgggtgaatttggttaggaattgtggtgttagtttttgatatttgagtaggttggatggggtttagggttggggtttgaataatggtgttttgagtttggatggtgattgtgggttttttaggaataggatttttgattggaggagttatggtttttgttggaggagtaatggttggagatgtgggggttggtatgattttggatgggggtttttggatagttgtggttgggggtttaatggtagtgataggtgtgggtgtagtatggatttgtttttggatgtgtttgggaagagggggttttttattggtgatgtgttaatttattatagggtagttaagttgagtagatattgtgttttttttggtaggggtttttatattatgaatgttaggtatattgttttggtttagggagtagtttagtttttaggagagaagggttttattttttattattttttttgtattttttgggttagttatgaaggttgatatgttaaatagtttgttatttattattggtattaattttatgttgtgaagttttatttttgagaagttttgtattttgtgtaggaggttaattttttgttttggggttattttggtgaggttggtatttaaaattattgttaaaatagttataggtttatttgtagtataggtagatgatattattttattagggtttggggaggttgtttttattgattgtagtttattgtggtttttagggtagattttgatggagaatatattggaggtttgggggatgtggtttttgttggtttttagttgtgtagtgtttattgaaatgtaatgtatatttttattagtgttaagggggaggttttttagggtgtggttttgtgagttttagtgtagttaag

SEQ ID NO: 771 - DNA, 6001 bp, Artificial Sequence
  chemically treated genomic DNA (Homo sapiens)
atagggtgggggtgggggtgttgttttgaagtaagaagagagaggagggtggtagaaaaggttattgagattaagaattgttttttaaatgaattaaatttttttttggtattaagaagggatatatagtattttgagttttgtttttgtttttttattaagttttttttaatagttggaagtggttgaagggggttgttttaaggagattttttgttttttttttgatagttgattaaaagaaaataggttatgttttttaaatttatgtttattttgtttttaattattgtttttttaaataaaggtaatatttgtgtaattttagttagtttgaatttttggaggtaaatagagtgtaatttgttttggaagaattttgttatgtttaaggttttatgttgggtgttggtttttttgtttttaattatttttttattttgatttggattgtagaaatttttaattttttgttttttagttttatttttatttttagatttggggttgttaaataatggaaattttaggaagatgtaggtgtggtttttaaagttttggtttgtgagtgtttttaggttggttggggtgttggtttttttagaaataaggtttgaatatgtaggtgttagttaggattttttgttgtttgtttattgttgttttttttttgggatttgagagaagtgggagtgtgtgtgtgtgtgtgtgtgtgtgtgtgtgtgtgtgtgtgtgttttgtgttaggagaaaggtttgtggttgttgttttagttggtttgtttattttttgtttttaggagaagtttgtttatttgggatattagtgattttttttatttttattttattggttttatattttttttatttttttttaagttgttgatgtagaaagtatttggttattttgaaatggtagtttttggaattttagttttgttttgtaatttagtagggttttttggaagttttataattgagatttatgggtttattgggtaattaaatgatgttattgtgttaattttgtatgtattattgttgtttgtgttgtttgtgggttgttggttggttgtagtttgttggtgatgagggtattatagttgttttgattgtgtagattatgtatgttttggttttgggaatttattatgtattagaatatattagtgtttgtattttaaaaggttaaattattggtttttagttagggatttttggtaagtggtttgttagtgatgagtgtttgtttatattggtatatagtggagttttttgtttttggtttatttgtttttaggaaagttttggggtgaggtgaaggtgattgaagtaatgtttttttttttagattgtagttgtttaggggggatatagtatggtattttttattgaattttttttgtttgtttgtattttagtttttttttttttagtgatttttttatttttttttttttttttttttttgatgtttgattttagtagtaaaggaggtaaaaaaggtattgagttgttagttaaatttgaaaagtgtggttttgttttttttatagttattggtagttttttgtggaaggtttgttttttggggtagttgtggttttggagtggttgtgtttggtgtttgttgggtgtggttttgttttaggtttgggagggtaggttggttgttttggtgagtggtagagtttttttggatagtttttgtttatttaaatagaagatgttggtgttggagtgggtttggatatggtgaggttgtgagttggtttgagtggtggggtttggtgatttttttttttttttttgttttttttttttttttgtatgtatgttttgtttgtttttattttgtttttattttgggtgagtttgtttgtagtttggggtgtatatttgtatgtgtatttttttttatttatttttgtgtttgtttttatttttgtagttgagttttgttatgtgtgttttgtttgtttgttggttgtttttgttgtttttgttgtttttgggttttgatggattgaatgaaggttgtttatattgtttattgatgttttattaaagatttagaaggttgtgttatgaatttggagttgataatggaaagtttgggtattttgtatgggttggttggtggtggtagtggtgggggtggtggtgggggtggtgggggtggtggtgggggtttgggttatgagtaggagttgttggttagttttagtttttattatgtgggttgtggtgttgttggtttgttgtggggttttttgttgtttttaattgtgtattaggagttgggtatggtggtagtggtggtagtggtggtgttgtgtttggttatggttattagtatggttttgattttggatggtggtgattattggtttgagttttttattttgttgtattatgttatgagtatgttttgtgatttgtttttgtttggtatgggtatgagtaatatttatattatgttgatattgttttagttgttgttatttatttttattgtgtttgataagttttattatttttatttgtattattatttgtattattattattattattattattagtgtttgtttggtaatgttagtggtagttttatttttatgtgtgatgagtgtgggtttttggttatgaataatttttatagtttttataaggagatgtttggtatgagttagagtttgtttttgttggttgttatgttgttgggtaatgggttaggtggtttttataatgtgtagtagagtttgtttaattatggtttgttgggttatgataaaatgtttagttttaattttgatgtgtattatattgttatgttgatttgtggtgagtaatatttgttttgtggtttgggtattttatttgtggttatgatgttgtatttgaatggtttgtattatttgggttatatttagttttatgggttggtgttggtatttagttgtgagtggttatttttgtttttattgggtttgtaggtggttatgttgggttagttggaagaaattaatattaaagaggtggtttagtgtattatagtggagttgaagtgttatagtattttttaggtgatttttgtgtagagggtgttgtgttggttttaggggattttttttgatttgttttggaatttaaaattgtggagtaaatttaaatttggtagggagattttttgtaggatgtggaagtggttttaggagtttgagttttagtgtatgtttgttttatgtttggtaggtaaggttggggttagttaggggttaggttgttgggaagagggttttgggtttggtgtttgtggtttaagtttgtgtgttgagttattttttttgatttttttttttttttttttatatatgttttttttttttttgtttttatttttttttttatttttttttttttttttgttttttttttatttttttttttttttttttttttttttttttattttttttttgtttttgagtttttattgattgatttttttttattttatttgttttttttttaatgtgttaatttttgttttatttttgatttttttaggtattgggaggtgggatgggggtgtgtgtttttttttaggagttttgtttttttaagatttatagaaattaggatttgtttttatttaaaattttatgtattttaagttttttttagataatatattttaattttttgggttgattagtttttttgtgtagaggtagttgagaggttttgttttgtagagggaaaagagttttttatttttttatttattatataggtaaatttatttggttattggttgaaggtatagttttgtttttgtggggaattggtggttaggatataatagtgtttttggagtttatttttggttttggtgttggtgtagggattttttgattgggtttgaggggtttgggttagttttaatgttattatttatagtgagggtagggtgtaaggttgagaaggttatatttattgttttgggaggatgtgggagaagagattgaggtggaaagtgttttgttttgtttattggttgtttttgttttggttttagtgtttgttgggatttgttaggatttgttggggttttgggagattttgagtatttgtaggaagaggtgttgagaaattaaaaatttaggttagttaatgtatttttgttgttggttgtaggttttgtttttgtattaagtgggtgttgattgtgtgtgtttggtgattgtggggaggattggtggtttgtgggaggggatgggtagaggtgtgggttatattgttttggagttggtttggttttttgtgttttttttagtggttaagttgtgaggtatagttttttattgttttaggagtatagaaattttttgtgtgggtggtgggtgtgtgagttagagggaaagatgtagtagttattgtgattggtatgtagttgtgtgtttttgtgtgtatggattttgtgtggtgtgtgtggtgattgtgttgtttttaggagtaagttatgggtttagaggggtaaaatgtttaggttttttgttgggaaggatatattatattttatggtaagttagggtgggtgattttttatggattgggtggaggggggtattttttaggattggtgggtggtttaggggaataatttgtggtggtgatgatttgtatagtgtgggttttgggatgtgtgtggttttgagttagttttgtatagtttgtttttggagttgtgagtttaggtttttatttttgattttttgggttttttttgtattgttgagtttagtttgtggggtgtatttgattaatgtttgatagggttggggaatgtgataggtagtaggtttatttgggtttggggagggggagtttttgttttgatagtatttttttttgttgtttgttggtggatttttatttttagttggtaattgttttgtagtgttgatttaagaaggtaaagaaaattaggtttttttgtaaagagttttttttaaattggtggattttggatattttgagtggatttagaaatttatgtaattttttttttttagtttattttttatttttttttatagttttttttgatttgttgttggtttggggtaagataaagtagttagtagagagtgataataatagtggtgggaaatgaattggagattggttgatagtttttaatattttgttatagatttttttgaatgttttaggttgtttttggtgggttttagtatttgttggttttttgggtattggggattagaaggaatttggtagttggttttaggggtatagttaaaggtaggatgatagttatttttttgtttattttagagtgttgttgtttttttatgttggttgtgtaaagaatatagtttttaaaaaatatgtgttttttgtttatataggtttgaaagtgatgaggaaagtaatgttttgtttattagtgagttttagtttttaaaatgattttaagtgttgttgagatgagaaagtgtggtattttgggggtttttagttttatttgtgtttatggtgtaagtttgtagggataggtttgggatagtattgtttatgttgttagattttttgtagaggattgttgaagttgtttttgtgggagatagaatgttttttttagtgagtggaaaaggtttgttgaggattttgttttgtttgagtatttaaatgtgtgtttgttttattattttgggttgaaaagggataagagttttagtttttttatttggttattttattagtaattataagtgtgttgagtggttattattatataggaggttttttagtttggggttagtagattagtttttttagatattgatgtagaagttgggattggtaagtaggtattatgtgtttggagtgttaggggataggagtaaatggagaagaaaagtggaggttttttttgtttggagtattgattggaatttttgttggtatgt

SEQ ID NO: 772 - DNA, 6001 bp, Artificial Sequence
  chemically treated genomic DNA (Homo sapiens)
gtgtattggtggggattttgattgatattttgggtggagaaagtttttgttttttttttttatttgtttttgttttttagtgttttgagtatataatatttatttattagttttagtttttgtattagtgtttgaagagattgatttattgattttaaattgaaaagttttttatgtaataataattatttaatatatttgtagttgttgataaaatggttagataaaaaggttaaagtttttgtttttttttaatttagggtaataaaatagatatatatttgaatgtttgagtaaagtggggtttttagtaggttttttttatttgttggaggaggtattttgttttttatgaaggtagttttagtgattttttgtggaaaatttagtagtgtgggtagtgttgttttgggtttgtttttgtagatttgtattatgggtgtgggtggggttgaggatttttgggatgttatgtttttttattttagtaatgtttgggattattttaaaagttgaaatttgttaataggtgaagtattattttttttattatttttagatttatatgggtagaaggtatgtgttttttaaaagttgtgttttttgtgtgattggtatgagggggtggtagtgttttgagatgagtaggagaatagttgttattttgtttttaattgtatttttaagattagttgttaagttttttttggtttttggtgtttaagaagttggtgggtattaaaatttattagagatagtttgggatatttggggggatttatgataaaatgttaagaattgttagttagtttttagtttattttttgttgttattattattgttttttattggttgttttattttgttttgaattaatagtaaattagagaaaattgtaggagaggatgaaaaataaattaaaggagaaagattatataaatttttaaatttatttaaagtatttggagtttgttgatttgggggaggttttttgtagggaaatttagttttttttatttttttagattaatattgtggggtgattattgattgggaataggaatttattagtagatggtaaaggaaaatgttgttaaagtggaaattttttttttttaagtttgggtgaatttgttgtttgttatattttttagttttgttgggtgttggttgagtgtattttataagttgggtttagtggtgtgaggaaagtttgggggattgggggtggaaatttgagtttgtagttttggaagtgagttgtgtgaggttggtttggaattgtgtgtattttaagatttgtgttatgtaaattattgttattatgaattgtttttttagattgtttgttgattttgaaagatatttttttttatttgatttatgggaagttgtttattttggtttgttatagggtatagtgtgttttttttagtgggggatttggatattttgtttttttgggtttgtggtttgtttttaggggtagtgtagttgttatgtatattgtgtggggtttgtgtgtataaaagtgtgtaattgtgtgttagttgtagtaattattgtatttttttttttagtttgtgtatttgttgtttatataggaggtttttgtgtttttagaataatagagggttgtattttgtagtttggttgttagaggaggtataaagagttgagttggttttagaataatgtaatttgtgtttttatttgtttttttttgtgggttgttagttttttttgtggttgttaggtgtgtataattagtgtttgtttaatgtaaaggtggagtttgtagttggtggtagggatgtattaattaatttgaatttttaattttttagtatttttttttgtgagtgtttagggttttttggagttttggtaaattttggtaaattttagtaaatgttgggattggggtaaggatggttggtgagtaaggtaaagtgttttttattttagtttttttttttatgtttttttaaagtggtgaatgtgatttttttaattttatattttgtttttgttgtaggtagtgatattggagttggtttgagttttttaagtttggttagaaagtttttgtgttaatgttaaggttagagatgggttttaggagtgttgttgtattttggttgttggttttttgtgggggtaaggttgtgtttttagttaatgattaaataagtttgtttatatggtgggtgggagagtagagagtttttttttttttgtagagtaaagttttttaattgtttttgtatagggagattagttagtttggaaaattgaaatgtgttgtttaaaagagatttgaagtgtatggggttttgaataagggtaggttttggtttttgtgggttttggaaagatagggtttttagaggaaaatgtatatttttattttgttttttagtatttgggaagattggaaatagggtaaaggttggtatattgaggggagggtgaatgaaatgggggggggttggttaatgaaagtttagggataaggagagagtaagaaagaaaaagaaaagggagaagggaaagtaggggaagagtggaagagaaagagaaaatggaagaagaaataaaaatgagaagaaagaggatgtgtataggaaagagaaggaaagaattaagagaagtgatttggtgtgtagatttgggttataagtattggatttggagttttttttttagtagtttggtttttggttagttttggttttatttgttaggtgtaaggtggatatgtgttggaatttgggtttttgaagttatttttatattttgtggaaggtttttttgttagatttgagtttattttatggttttggattttggagtaggttggagagagttttttgagattggtatagtattttttgtgtaaagattgtttgggggatattgtagtgttttagttttgttgtgatgtgttgggttatttttttggtgttgattttttttagttggtttgatgtggttatttgtgagtttgatgaggatgagggtggttgtttgtgattgggtgttagtattggtttgtgagattgagtgtggtttgggtggtgtaggttgtttaggtgtgatattatggttgtaggtggggtgtttaggttgtgggataggtgttgtttattgtgggttagtatggtagtgtggtgtgtgttgaagttggggttgagtattttgttgtggtttggtggattgtagttgggtagattttgttgtgtgttgtggaggttgtttagtttgttgtttagtggtgtggtggttagtggggataggttttggtttatgttgggtatttttttgtagggattgtagaggttgtttatggttgggagtttgtgtttgttgtgtatgagggtgaagttgttgttgatgttgttggataggtgttggtggtggtggtggtggtggtggtgtggatggtggtgtgggtgagggtggtggaatttgttagatatggtggagatgggtggtagtggttggagtggtgttagtgtggtgtaggtgttgtttatgtttatgttaggtggagatgagttgtaggatatgtttatggtgtggtgtagtgggatggagagtttgggttggtagttgttgttgtttaggattgaggttatgttggtgattatggttgagtgtgatgttgttgttgttgttgttgttgttgtgtttagtttttggtgtgtggttggaggtggtggagggttttgtagtgagttagtggtgttgtggtttgtgtggtgggggttggggttggttagtagtttttgtttatggtttgggtttttgttgttgtttttgttgtttttgttgttgtttttgttattgttgttgttggttggtttgtgtaaagtgtttagattttttattgttagttttgggtttatggtgtagttttttaggtttttggtgaggtattgataggtggtgtaggtagtttttatttagtttattagggtttgggggtggtgggggtggtgggggtggttggtgggtgggtaaggtgtgtgtggtggggtttggttgtgggagtgggggtgggtgtgggagtgagtggagaggagtgtgtgtgtgggtgtgtgttttgggttgtgggtgggtttgtttggggtgggggtggggtgggggtggatggggtgtgtgtgtgggagaggggaggggatggggagggagggagggattattgggttttgttgtttgggttggtttgtagttttgttatgtttgagtttgttttggtgttgatgttttttgtttgggtgagtgggagttgtttagaagggttttgttgtttgttggggtagttaatttatttttttggatttggggtggggttatgtttgatgggtgttaagtgtaattattttgaggttgtagttgttttgggaggtgggttttttatgggaagttattagtggttgtggagggggtggggttgtattttttaggtttggttgatggtttggtgttttttttattttttttgttattggaattaaatgttaaggagagggagggaggagaaggtgggggggttgttggggagagggaggttggagtgtgagtgagtgagagagatttggtgaaagatgttgtgttgtgttttttttgagtagttgtgatttgggggaaggggtattgttttaattgtttttgttttattttaaagtttttttggaggtgagtaagttgggagtaaaagattttgttatgtgttagtatagataaatatttgttattaataagttatttattgagagtttttagttgggagttaatagtttagttttttaaaatgtaggtgttaatgtattttaatgtatggtaaatttttgaggttgggatatgtataatttatgtggttagagtaattgtagtgtttttgttgttagtgagttgtggttggttggtggtttatgggtggtgtgggtagtagtaatgtatgtaaagttaatataataatattatttaattatttggtgagtttataaattttagttatgaggtttttgaagagttttgttagattgtaaaataaaattagaattttgggagttgttgttttaaggtgattaagtgttttttgtattagtgatttggaaagaagtggggagagtgtagaattggtgaggtggaggtgaggagggttgttggtgttttaagtgagtaaattttttttgggggtagagagtaagtaaattagttgagatggtaattatggattttttttttaatatgagatatatatatgtgtatatatatatatatatatatatatatatatttttgttttttttaaattttgggagagaaatggtggtgggtagatgataaggaattttggttgatatttgtatatttaaattttgtttttgaaaagattagtgttttggttagtttgagaatgtttataagttaaggttttaaaaattgtatttatgtttttttagaatttttgttgtttggtaattttaggtttggaggtgggagtggaattgggggatagagagttggagatttttgtagtttgagttggggtggaggggtagttgaagatagagaggttaatatttggtataaagttttaaatgtaataagatttttttaaagtaggttgtgttttgtttgtttttgaagatttaagttagttgaggttgtgtagatgttgtttttgtttaaagagatagtaattaaggatagggtggatataagtttgagaagtgtgatttatttttttttgattagttgttaaaagaagagtagggggtttttttaagatagttttttttaattatttttagttgttagagaaaatttgataagaaaataagggtagagtttggaatattgtatgtttttttttggtgttagagaaaggtttgatttatttggaaaatagtttttagttttagtgattttttttgttgtttttttttttttttttgttttagagtaatatttttatttttattttgt

SEQ ID NO: 773 - DNA, 3501 bp, Artificial Sequence
  chemically treated genomic DNA (Homo sapiens)
taattttgaaaattatttgtagatattttgtaggttttattttaggaataatggttatttttttgggtagttgaagtaaaattaagtttaatgataagtaaatataattattattaaaattttttatttatgtttgttaaagtaatttaagtatgatttgagaaggattttgtattttatatttgagtttttgtggatgaattgtaatttagtttaataggtagataagattgaaaatttaatttaggagtatgtgtttttaataatagttgagttttggttaattttagtggttatattttaattatttatatattgttgagtgtttaaattgtgtttaaagaaggtaaaagttaatttgtaattaatttagttgtttttttgttttatttttaatttttgtatgttatttttttttttttgtttataaatatgttttgattatgaggtatttttggagtttttgaatttgttgtgattttggaagttgttttatttgtaaattatttattatttaattaaattgttttaaatttaattttgttgaagtttttttttaataggtttagaaaaaataatggtaaaaatgaatgaaaatttaataattttggaagtagaaaaggttgggggttttaataagtgtaaatagttttatttttatattttttttatggtaattataatttagtatattatatatatatttttttgttttttgtattttggtttagggtaaagttttttaaaataggtattgttaattagtgttattaagaaggtttggatgttgttttgtgggaatattttaaagaggaatgtttaaaaggaaaagggggatgggttgggagaagggtattaggtgggtattttaaaattatttttagggttataggtttaatttatttggttgtggatgttagagttgttatggtaagaaggaagtaaagttttttgtaataattaaagtttttagaagtagtgtgttttattgtttattagtgtgttgtgaagtttggtgtttatttatagggttttttttagtattgtttaggttttttgagtgttttagtatagtagtttggagtttgttggtttggtgattaagatatattttagggaatatgttatgtagtggagttttttttttggtattgtatagtaaaaggaaagggttgttgggtgtttgtgggttttgggtagttatagaagttattgtgttggtggggaggagggggattgatgtggtttatgttttgggtagttttattttttttgtttgtgaagggtttttgtttggtgggaggagagaggtgtgttttatttgggtttttttatatttgttgttgtttgggttgattttgtgggttttgtttggtgttttagttgatttttgtttagttttgggtttatgggtgtggttagtagggtgggttagggtggtggggtgtgatattgggaggaagtgtgggttgtttgtttgggtgtgttaaggaagttgtttaaaatgaggaagagttgtgggtttggtggttgaggttattttggtggtggttggagagtgaggaggagtgggtggttttgtgttgtgtttgtttttgttttatttggtgtaggtaggtgtggttgtgttttttatttggttgggattttttggtaaggagaggaggttatggggaatgatgtgttgtttttatgtttttttttgttttatttttattggttgaggtaaaagtgttgaaattatgtgaataaaatataggtgggttttgttagttttgtttttgaatttatttgtgtttgggatttagaagttgtgttgggagagaggggtttaggtttgggtggaggggatggaggttagattgtgtggaaagtgatttgggtattttagggtgtttaggtttttagggagtgtggaaagtgtggttgtggtttggtttttgggagatgtgggattgggattaggtatagtgtgaggaagttgattttggagttagaatatttttttttggttatttatatgaatttattggaaaatgttgtagtgtttattaaagttatttaaagtagaaatgtttagatgttttatgagtttagataaattttttattataaaaagaaatagtagttgtatttaaataataatttttttgaattattattaaaatttagtataattatttttgtggatatatttttattgttaagtaatttatttagttaatgaatttggagagtaagaaagttttatgtagtaaaatgtaaatttgagttaagagttaagggtgtttttttttgtttgtttgtttgtttttggtaatgtggttttaaaattttaagtttatttaaaaattatataaatgtaatttatttttttgttggaatgtttaaggattagaaagataattggagaagtgagagtttgaatttttttttatgttggaaatagtgttgtaaaatattttttgagttttgtttgatttagtaaagatttagttgaatttaagtagagtttaaagtattgtagtgtgtagtaaaaaaaaaaaagagttgaagatgttgtgttatatttgatttttggtattaaaaataaaaaaaggaattatttaatttttaagagtttttggaagaaatggaattgattttattatttgatttttttgttttagtagggataaatttattgtttttatataggtagtattttaattaaatgtaattaaatatattgatgttttttttttttttagtgaaagtttgagtagtgtatagatagaattatatttttttaaaaaggtttaaatatatgtaaattattaagtgttttaagtgagaaatttttgttagttgaaattattttattaaattatttttgttttgaatggtatttttgttttaatgtatttagaaaatttttgtattaaaatagaaattgatttgtattattttttgtatttgaagtgtattttaaagtgtatttgaatgagagattataattaaattatttgatttgtgttttatttttttatttttttattttggatttgaaaaggttggatttgaatattaggaaaaaagagatttttttattgagggattgtgggaagatttttttttaagtttttgtatttgaagtgaaatataaaataggattttataatagttttaataattagaaagttttaagttaggataaaaatggggtgtatattttaggtttttattttttttgagagatgaaattggtagaaatgttattttattgttagattttattttagaaatgaattattttgatttttgttaggtttttatttaatattttaaatgtaggtttaatttttttgtttttttttaatggaagattttttagtagaattttatttatttagtatattgtttgtttatggttataatttaatatgtttgtgttaagatgtattttggaatttaagtttttttagaatttggaattaaaatttagaatttaaattttagaat

SEQ ID NO: 774 - DNA, 3501 bp, Artificial Sequence
  chemically treated genomic DNA (Homo sapiens)
gttttgaaatttagattttaaattttaattttaaattttgaaaaagtttgaattttaaaatatgttttggtataagtatattggattataattatgggtaaataatgtgttaaataagtgaagttttattaagaagttttttattaaaaaaaagtagagagattagatttgtatttagaatattaaataggggtttaataaagattagggtgatttatttttaaagtgaaatttagtaataaaataatgtttttattaattttattttttaggaaagataaagatttaaagtatatattttatttttattttagtttaaaattttttagttattaagattattataaaattttattttatattttattttaaatatagaggtttaaaaaaaaatttttttataattttttagtagaaaaatttttttttttttagtgtttaaatttaatttttttaaatttaaggtagaagagtaagaggataagatataaattaagtaatttgattataattttttatttaaatatattttaaagtgtattttaaatataggggataatataaattaatttttgttttaatgtaagagttttttaaatatgttaaaataaaagtgttgtttagaataaaaatgatttgataaaataattttaattgataaagattttttatttaaaatatttaataatttatatgtatttaagtttttttgagaaaatataattttatttatgtattgtttggatttttattggggagaaggaggatattaatgtatttagttgtatttaattaaaatgttgtttgtgtgaaggtaatgaatttgtttttattaagataaagaagttagatggtagaattaattttattttttttaggaatttttagggattaaatggtttttttttttatttttaatattaagaattagatatggtataatatttttaatttttttttttttttattatatgttgtaatgttttgaattttatttgagtttgattgaatttttgttaagttaggtaaaatttaaaaaatattttgtaatattgtttttaatgtaaaaaaagatttaaatttttatttttttaattgtttttttagtttttgaatattttaataaaagaatggattgtatttatatagtttttaggtgggtttaaggttttggagttatattgttaaaaatagataaatagataaaaagaaatatttttaatttttaatttaaatttatattttattatataaaatttttttgttttttaagtttattggttaagtaaattatttgataatgaaaatgtatttataagagtaattatgttaaattttagtagtggtttagaagggttgttgtttgaatgtaattgttgtttttttttgtagtaaaagatttgtttaagtttataagatgtttggatatttttattttgagtaattttgataaatattgtggtattttttagtggatttgtgtaaatggttaaaggaaaatgttttagttttaagattgatttttttgtgttgtgtttgattttaattttgtgttttttgagggttgggttgtgattgtattttttgtgttttttgggggtttgggtgttttggggtgtttgggttattttttgtatggtttgatttttgttttttttgtttaggtttgagttttttttttttggtgtagtttttggattttgagtgtgggtaggtttaggagtgaagttggtggaatttatttgtattttatttatatggttttagtatttttattttggttgatgaaggtagaataagaaagggtatgaaagtagtgtgttgttttttgtaattttttttttttattagaaagttttggttgggtaggggatgtggttatatttatttgtgttaggtgaggtgagggtgggtgtagtgtggggttatttgtttttttttgttttttagttgttgttggggtggttttagttgttgggtttgtggtttttttttattttgggtaatttttttaatgtgtttgggtaggtggtttgtatttttttttagtgttgtgttttgttgttttggtttgttttgttgattgtgtttatgagtttggagttgggtgggaattggttgaagtgttgggtgaggtttgtggaattggtttaggtggtggtaggtgtagaggagtttgggtggggtgtgtttttttttttttgttggataagggttttttgtaggtagagaaggtggggttgtttgggatatggattgtattggttttttttttttttgttagtgtggtggtttttgtgattgtttaggatttatagatatttagtggttttttttttttgttatgtagtgttggggaagagattttattgtatggtatattttttggagtgtattttggttattaaattaataagttttaagttattgtgttggagtatttgggaggtttgggtagtgttgagagggattttgtaggtgaatattagattttatggtgtattagtgggtaatggggtatgttgtttttgaaggttttaattattataaaaggttttgttttttttttattatgatggttttgatgtttataattaaataaattaaatttatagttttaagaatggttttgagatatttgtttgatattttttttttaatttattttttttttttttttggatatttttttttaaaatgtttttataaaatggtatttagatttttttgataatattggttggtagtgtttgttttaaaaagttttattttaagttaaaatgtgagaagtaaaaaaatatatatataatgtgttggattgtaattgttatggagaaaatatagggatgggattatttatatttattggagtttttagttttttttgtttttagggttattggatttttatttatttttgttattattttttttaaatttgttaaaagaaaattttagtagaattaaatttaaagtagtttaattgagtaatgaatgatttgtgaatggggtagtttttagaattatagtggatttagagattttagggatgttttatggttagaatatatttatagataaaaaaagggaagtgatatatagaaattggaggtaaggtagagaaataattggattggttataggttggtttttgttttttttgaatatagtttgaatatttagtagtgtatgaatggttgaagtatggttattgggattggttaagatttagttattgttaaaggtatatatttttaaattaggtttttaattttgtttgtttattaagttaggttatagtttatttataaggatttaaatatagaatatagagttttttttagattatatttaggttgttttaataaatataaatggaagattttgataatggttatatttgtttattattggatttaattttgttttaattatttgaaaaaatagttattgtttttgagatggagtttgtagaatgtttatagatggtttttagagttg

SEQ ID NO: 775 - DNA, 4001 bp, Artificial Sequence
  chemically treated genomic DNA (Homo sapiens)
ttttattttttttatatttgtgttatatattaaaaaattatatattagagaatttaaaagatttgttaaagttgtttagaaagtgatttgatgttaagatggtgtttttttatttgtattatttttatagtttagaagtatattattaatttatgtttttttttataatttggagttatatatggattatgttgttttagttattttgtttaatttgatttttaatattgttattgattttatttttaagtgttttattttaaattatagagtgttaaagatgttggattatttttataatgttatttttaagtttggtgaattaagaaattgttagattattttgtgtaatattataatggtattgttgtaatattatatgttaaatttagaatgtgtaaagattagaagttgatagtaaattattttaggatttataatttgtaaaaatgaagtttggtgttatgaattatgttgtttttaaaagaaatgtaagtttatttttgtaaattttttttttgagaaagtagattattttgatgtgtttttaagtaagatgtatattattttttaagttagttatttttgttatttagtttttattttgagtttttatgtaaatttgggttttatattaaaaagaaatgtatattgtaattgaaaatttgttttggaatataattaattgtttttttaatattttttttatatattattttttttagtaggaaatggtaaggaatatgatttatttaaaattttaatgatttttattgtaaaaaaaataataaatttaagaaaattaaagttgaaattaatatgaaaaattatgaattttttataaatgatgattatttttgttttttttaaataatttaagaatatagtaatgtattatatgtaatttggttgattaatattatgaataattgaattggtattaagttaagtaattatttaaaagatatttttagaaattttaaaagattttttttttaaagtaaaatatttgatttttgattgggaaaaagattgaagagtttaagaaataaaatatttatagagatgaaagggagtttttgtatttttaagggatttatatagtgttagtttatagttttttatatgtgtttatagtttattttttaatgttaataaggagggataaaaaaggttttttattttttagtgtttattttttaattagttattaattaatgttaatgttaagataattaaggttagttgtaaaaaagtttttagaaatttattggaattaattaattagatttgggtaagtgatttattattgtaaatttatgaataatagttagagaaatattattaattttgatttttgtagtattttattaaagaagaaaaatgaaaataatgatatttaagaaattttatgttattatttaagtttgtatgagaatatttatttaaaagataattagaagttatagttatttagttgaataagtgaattattttattatgggttagtttgaagatatagttatatattatttaaaaatggataataaaataatattataatgtttatttgttttttgtttggtttttggaagttatttaaaagaatgtttttttaatgatatatagtaatttttgaggaaaatttttagattttgataggtatttaagtattttagtaggagatattgggtttttggtttttgttagataatattttattttatgattatagttaaattttatagatttttttttaatttaattataagtgttgaaaagagaatgagtaaaagtttgttttagtttttattaaggtatatgtagagattttggaattttttttatatttttaaatattttattttttaattaaagttttttaaaattattttatttatattatttttttttgggttttttgtaggatgtgtttagggtggttgattgtggatttgaagagggattttagttttgttttatgagtttttagtaattgtagttaatgaagtttttatttgtttttatattagtagagtgtttttatttgtatttaagttttgggattaataggaaattttatttaatgattgaagggtatttggtgtaattattatgatgttaatttttattatgatgttaatttgattttattttgttttaatttttaggttatttttgtttggagttatttttaggtgatggtgatgataaggttagtttatgaaaagagagtatgttgttattttgtatgtaattttattgagttatatatataatattttgaaagttgatatttttttataaataagagatatttaattagttaagtatttgatatttatttaaataagagttatagatttttgaaaatagatatagagtatttttaggtttatattattatttaattaggaaatagaaaaataaaatatatatttatttagatttttttaaaattaatttgtatttgaatttaataaagatgtatgagaaaggtatgaggtaattttaagaaggattgaatggtttttaatatatgtgtttggtttttggttttttttttttttttattttatttttgtaaagtttagtttttgtttgaatagaaaatatgtatgttatggtttgttaggtgtgggatatttagttttaaggtttttaatttagtgttattttaaaatttgtatagttttttagattattgtggttttttttttgtatatagagattatgattttttaaaagtttttatttttatttattttgtttagtgttatttttgtaaggaattggtttagatatagattattaaggatttttttaataaagagtttagaagatttatgtgatgtaaaaagtaatttttgtttaatataaagaaatttgttaaagaatgtaaagttgttttgtgatttattttttgtgataaataaatttgtttaggtttttatatttttttagatttttgttgtttttttttagtatgtattttaattatttatttttttttagtgatgtttttttttgggggatgagtgggggagatggaattttgttttgttttttaagttggagtgtagtggtataattttattgtagtttatattttttgggtttaagtattttttttgttttagtttttgagtagttgggattataggtgtgtgttataatgtttggttaatttttgtatttttggtagagataggagttttattatgttggttaggttggtttaatttttgattttaagtgatttatttattttggtttttaaaagtgttgggattataggtatgagttattgtgttgggtttttttagtgatgattgatgttattattatttaagaatttttatatttaaatattaattaattggtagtatatttttaatgtagtagatttattttgaaaatttttttatttaggtattttatttttttttgttttatttttttttttttatttgtgttttttttatatttttttattttttttttatttgaatgattatatagaaataatgtttttaggatgtttttattaaattatttttgtttggtttatgattttatagtggattttatttttattttatatttttatataagaattatgaatattagggaatttttatgaaaatgtttattgtgtttttaaagtttatatattgttttttaatttttttagtgatgtggttatataaataatataaaagttagtgtttttaatatttgatttattttttttatttttttaattattttatttagaagtaatgtttttagttttttatttgtgtttttgtagatattttatgtatatataaataaattatatttaagtttttatttttgttgaaattttttttaaaataataaatagaatataaaaattagaggaatttttgtttttgtgtttagagaatttttgttggtatggtataaattatatttttttgtattttttataataaatatatattatttttataatt

SEQ ID NO: 776 - DNA, 4001 bp, Artificial Sequence
  chemically treated genomic DNA (Homo sapiens)
aattataaaagtaatatatgtttgttgtagaaagtatagagaagtataatttatattatattaatagagattttttaagtataaaggtaggggtttttttaatttttgtattttgtttgttattttaaggagaattttaatagggatggagatttaaatataatttgtttgtatatatatagagtatttgtagaaatataagtaagaaattggaaatattgtttttgagtagaataattgaggaaatggggaagataagttaggtgttaaaggtattgatttttgtattatttatgtagttatattattaaaaaaattaaaaaatagtatgtaaattttaaaaatataataaatatttttataagaattttttaatatttataatttttatatagaaatgtgaaataaaaataaaatttattatgaaattataagttaaataaaaataatttaataagagtattttagaaatattgtttttatgtaattatttagataaaaaagaaataaaaggatgtaaagaaggtataaataaaagagaaagaatagaataaagaagagtgaaatgtttagatggaaagatttttaaaataagtttgttatattgaaaatatattgttagttggttgatatttaaatgtagaaatttttgaataatggtggtattaattattattaggaaggtttggtatggtggtttatgtttgtgattttagtatttttggaagttgaggtgggtggattatttgaggttaggggttaaattagtttggttaatatggtgaaatttttgtttttattaaaaatataaaaattagttaggtattatggtgtatatttgtagttttagttatttggaggttgaggtaggagaagtgtttgaatttgggaggtgtagattgtagtgagattgtgttattgtattttagtttgggagatagagtgagattttgttttttttatttgttttttaaaaaggagtattattaagaaaaggtgaatggttgggatgtatattggaaggaaataatggaaatttgaaaaggtgtaagaatttaaataaatttgtttattatagaaaataaattataaaataattttgtgttttttggtaagtttttttatgttaaataagaattgttttttgtattatatagattttttaaattttttgttgaagaggtttttggtagtttgtatttaagttagttttttatggaagtggtattgagtggagtagataaagataggaatttttgaagggttataatttttgtgtgtaaaaaagaagttatagtagtttgaagagttgtgtaggttttagggtgatattgggttgggaattttggagttaagtgttttatatttggtaagttatgatatatatattttttgtttaggtagaaattgagttttataaaagtgaaatgagaaaaaaaaaaaaattaaaaattaggtatgtatattgagaattatttagttttttttagaattgttttatattttttttatgtatttttattaaatttagatgtaaattaattttagaaaagtttaaataggtgtgtgttttatttttttgttttttaattaaatagtggtataagtttggaaatgttttatatttatttttggaaatttatagtttttgtttaggtaaatattaggtatttagttaattaaatgttttttgtttataggaaagtgttagtttttaggatgttatgtgtatggtttaataaaattatgtataaagtgatagtgtattttttttttatgggttgattttgttgttattattatttgaaaatggttttaaataaaaatgatttaagggttgaaataagataagattaaattgatgttatggtaaaaattgatgttatggtaattatattaagtattttttaattattggatggaattttttgttgattttagggtttagatgtaggtggaaatattttgttggtataaaagtaggtgaggattttattaattgtagttattgagaatttataagatgaagttaaaatttttttttggatttatagttaattgttttgaatatattttgtaaaaagtttagagaaaggtaatatgaatgaaataattttgggggattttaattgaggagtaaaatatttgagaatatgaggaagattttaaagtttttgtatatattttaataagaattgagataggtttttatttattttttttttagtatttatgattgaattagaaggaagtttgtaaaatttggttgtgattatagggtaagatgttatttaatagaagttagaaatttaatgttttttgttgagatgtttgagtgtttgttaggatttaaaaattttttttaagaattattgtatgttattggaaagatgtttttttgagtggtttttaggagttagatagagggtaagtagatattatgatattgttttattatttatttttaagtgatgtatagttatatttttaagttggtttatgataaagtggtttatttgtttagttgaatgattatagtttttgattattttttgaatagatgtttttatgtagatttgaatagtagtatggaattttttgaatgttgttgtttttattttttttttttaataaaatgttataaaaattaaagttggtagtatttttttagttattatttatgaatttgtaatgataagttatttgtttaagtttaattgattagttttaatgagtttttggaaatttttttgtagttaattttggttattttagtattagtattaattggtggttgattgggaaatagatattagaaaataaaagattttttttgtttttttttattagtgttgaagaataggttatgggtatgtgtgaagaattatgggttgatattatatgggttttttaggaatgtagaagtttttttttatttttgtagatattttgttttttaagttttttaattttttttttagttaaaagttagatattttgttttagaaaaggaattttttaaagtttttgaaaatattttttaaataattatttgatttaatattaatttaattatttataatattggttaattaaattgtatgtaatatattgttatatttttgaattatttaaaaaagataagagtggttattatttataaaaggtttgtggttttttatgttaattttaattttggtttttttaagtttattattttttttgtagtaagagttattgaaattttaagtgagttatattttttattattttttgttgaaaagggtagtgtgtgagaaaaatgttagaaaagtaattaattatgttttagagtagatttttagttgtagtgtatatttttttttaatgtgagatttaaatttatatgaaaatttaaagtaagagttgggtaatagaaatggttaatttagaaggtaatgtatgttttgtttaaaagtatattaaagtaatttatttttttaaagagaaaatttataggagtgaatttatattttttttgagaatagtatggtttatagtattaaattttatttttataggttgtgaattttagagtagtttgttattaatttttgatttttgtatattttggatttggtatataatgttatagtagtgttattgtaatgttgtataaagtagtttagtaattttttggtttattaggtttagagataatattgtagaaatgatttagtatttttaatattttgtggtttaaggtggggtatttaggggtagaattaataataatgttagaaattaaattagataagataattgaaatagtatgatttatgtgtgattttaagttataaaggaggatatggattaatggtatatttttaggttataggggtagtataagtggaaggatattattttagtattagattattttttgagtaattttggtaaattttttaaattttttaatgtgtagttttttaatatatgatataggtgtaaagaaaataaag

SEQ ID NO: 777 - DNA, 6001 bp, Artificial Sequence
  chemically treated genomic DNA (Homo sapiens)
ttttaatattagaaggaataaattttgaatatattatttttaagaattgtaatatttattgtgagggtttatggttttatttttgaagttagtgagattaagaatttattaattttggatataaggtgataggttgagggtggtggtttggttttgggtttttttggggtttttttagggaatgttttggtatttgttgattgagttttgggaggtagttttggtatatagttttttgatatgatttgttttttattttggggtgttatatatgaagggaggtgattgttgtgatggtgttggtaggattgttgtttttgatgtggggtgggttgagttaggtttgaaatatgggtttttaggttgagttttgttttttttattatatttagggttgattgatatttttagttagtttattttggttttttttttatatgttaggataatgtagtttttgttattaatttgggtagttagagttgggttagtgggggatatgggattatgggtaagggtaattgatatttgtttagttttaatgtatttgttttaaatgtggttaggtggtggggtaagtaggaatgaggtaggggtggggttgttttgaggaggatgattttaatgagggtgtgagtaggggatttaagttggaattattatattgttttattgtatattagagtttttggttagggagtaggttggggattaggtattttattttagtggggtatagtataaagtttgtagggggatggggttattagaaagttgatgatatgagagtggttgggttggggttgtttggtggttatggagaagttgaagtgttgtagtagggaggtgaagaagaggaagagttttatgtgggttaggggttttttgaggtatgtatggtggtttgtggggaggggaggggtgttagtgagtttggtttttgggtgatatttttgtaagattttatggaaggggatagggagttgggttttttataggtatttgttgagaaaggtaggaaggtttttggttttataaagtggttttgggtatttaggaagtgtttggggtggaagtggaagggttttttttagatggttttattttttagtattgatgataggttggtgatgagtgttgttttttgggtaggagatgtagggtgagagtggggattggattttaggatgttgggatttttgttattaaatatatgggggatatatattgtttggtatatagttggattttgttaattagttttgtgtttgagaagttttatagtattttttttgattttatagtagggtgtagttatattttttagaggtatttatattgttttttttttttgtaggtgttgggttttttaatattttggtaggttttgatttgttttttttattagattggggttttggatggataggttagttttgtttatattttggattttttatttaagtggggatagttagtgtggtggtattgaggattaggtggttagggtttttagagtgggtttatttggtagtagttatgttggggttattattaggggttggtgttgagttggggtgaggagggtgttaggtttattttagggatgtggaagttttgtattttgatgttatgggatgttatatgggttatatttagggggatgatgtttttaaagtgttgtattttgtgaattatggtagtggtgtagggtatgtgagtttggttatttatttttggttgttgtatttgttttattatgttgttgattttttgttggatatggattggatagatatgtgtttttataatgggttagtatttaggggatattttttttttttttgtgttggaggaagttaggtttataggagtttggttatgtttgtgttggaagttttgggtgttttagttaagtttaggggtttttagttgtatttttttttttttagtttttgttttgggttttagttgggtttatgttgtatatttaggtgtaggattatgagtaggaggttttaggttagtgtggttgaggtggttattattttggtaaggaataggttatttattattatgtgtaggtttttattattgaagttgtttttagggttttttttggtttgagtagggttgagaggatatttaggggatagaatggggtagtttttaaatgatttttaattttgtatttgttagtttagatgtggtttgttgggtgatgtattggtttaattttttgtttagtttttttttattttttttgggatgtttaatttattatttttgttttttattgtggtagttatttttattttttttttttttgttaggaaggttttagttaggttttggggtggttgggttgggttttaggttattttgtgtttagttagtagtttatttagttgggttaggaaagttttttggaagtgtaggattttgttagttagtgttgggatgtgtgggaggatggggatagtatttagtatttatattagatagaatggggttttaattttttttgtgttttgtgtttatttggattagttttaggttttagttatttttaggaagatttagggtttgtttgtttttattattgattttattaagtttttttttaagtgttagtttttattttttttttttttgtttagaggagaaatttaaaattgaaatttttaatgtggatgggggtatagagtttttggttttttttggtgttttttgatttgggtatattttttttatgattatgtttgagatgttttttttttttttaggttttttttatagtggggttttttggaatgtttttttttaaatttatttatgtaaattttgttttttggaggttttagtttagttttggtattttttaggagtttgttttgtagagattttttggttttttgttttgtattttgtgtaggaagtttgattttttttttagttttttttgagttaggtttagtagtttgaggaagtgagggttgttgtatttgaagtggtgtttgtaggtgagggaggtgattatgttgtttatggttttgtttaagaggttgttggggtgaaaggggtgttttgggggtgggagatgtgggtaaggggttgttttttttgttttttgtttttttagtttttgttttgtgtttttttgtttattatttattggtttggttggtgaaggtggtataaaggtaggtggtttttttggttatttattgttttagtgattttttgtttaggtttaagttgtgtaaggtggatatggagaagtgtttttgtttgtgttatgtgggtttatagtgtgataggattatttttgggggtgggatgggtatgtgggtgttgttatgaaggttttggttttattttttgttatttattttaattttggtgttttataaggttttttgtagtttttagtttggtttagttgggtatagggtttattttttgtttatttatattgtttttttgtttggggtggggtttggttttattttgtttttgtttattttgattatttttttatttaaggaagattttgtttgttttgtttatattgagtttgtagtataggtgtggtttttgttattgttattttgatgtattagttttgtttattgggtttttggtgggtttgggtagtagttttgtttttttttagtttatagatttgtattttttttgtgtaggtggttttttggtttattgtttttagtttatttgttggtttttatttttgttttatgtttaggattttatgttttgttggtgttgtttgggttatggttattgtttatttggggtttatggaaatgtggtttttgttttttattgttgtttgttttgggaatgtggtttgaagtttaggatttggtagatgggtgtaggtgggtggttggttgtgtttttgttgtgggttattattgttttgtgtatggttgttagtttattgagtatgattattggtgtttaggttagttgtaggttgaatatgtttttgaagtggtgttgtaattgtagagggagggttagggttttttgttaagttaggattattttagattataggttttagttttatttgaattttggatgatttttggggttattaggagtgagtaggtggaaggaggagatttagttttttgattttggggtgggggtgggggttatattttttgtgatggaggaatttagtttggatgtgttatttaggtatgattttgtaagagttattaaaattgttgagaggttttagttagtattttatttttagatgatggtttatgttggtgagtagtgaggtttgaggatttatagtgtaaaaggtttgaattgggttattgtattttttttatttttgattttgtgatttaaatggtatttaggattaatttattttttatttttaaggtttttttttttggtgttagtagaagggattttgtattttataatatatgttgtttaatgggtttgtatgtttattgttaagtttagttttatttttaggtttttgttttatttttttttggtttttggaaaatttagttttttatgttatgtataaatgtttttttttaggatgttttttaaatttgttttttttttttagtttggtttttgatttagtttgtggtttaatttattatttatgtttgttggtggtggggtatttttaggatttttgttgttttttaggatttttttttttatttggttgaagtagtatggtgtgttttggaagtttatatgtagtaaggttgtttagtttgggtagtggtaggggatttggtgggtagtgtgtagtttagtgttggtgttggtgtattaggtttattaggagtaggaagatggttattattatggttaggggtattagtgtttttagttttatggttgttttattattaattgggtttttttggatatatttggtatttttattttattaggtatagaggattaggtaggatatttttggtatattgagtgtgtgattttttttttataaagggagttgatgatggtttttgttttttgttgtgagtgaatttgttgtgttgattgtgttgttagtggtagagttaggttagggtaggtatgggttgttttagaggtttttgttgttgttttttgttttaggtttttatttagggtagggtggtagaaaggtttggttggagaagttattttttttttttattttaagttttttaagtttatataggtttttgggataattagggttttagtggatttggttatttattttttagttaggtttatatattttaatgtagttataattttttttttagaatatgattttgttttttttttatttttatttgtttattttagagtgatttttagtatttttatttgttattggtatttatttggggttttagagtttttgatgatgagtggtattatgggtttggtttttttattttattttgtatttttgatatgtatagatgttatgtatatatttgatggtgtatagattttttgtttatttttagatatttgtttatttgtttatatttgtagggatatgattatatatgtagaaaattatttatataaagataatatttatatatatatagatttatattgatatttagggtatatatttttttttatatatattagttatatatatatatagatttggtattaagtattttattttttagttatgtttgaggttttttggatgggattttttttgtttagaggttgtttttggtgagttttaaagttgttatatggattttagtttagtttatattttgggttttggttgggttatgattttttgtttgtaatagggttgtttttagagtttttagttggtagtttgaaggtttttgttttagtttgtgatagtattttttagggttgtttgagggttgttattttttattgttttttggtttttatgtttttgattagaaatttggtggaaatatta

SEQ ID NO: 778 - DNA, 6001 bp, Artificial Sequence
  chemically treated genomic DNA (Homo sapiens)
taatgtttttattagatttttaattagaaatatggaggttaggaagtagtggagaatgatgatttttaggtagttttggaggatgttgttataggttggggtaagggtttttaggttattaattgggagttttgggaatagttttgttgtaaataggaagttatggtttggttagagtttagaatgtgggttgagttgggatttatgtgatagttttgaggtttattgggagtagtttttggataggagaggttttatttaggaaattttgggtatggttgggaagtggggtatttggtgttgggtttgtatgtgtgtgtgattggtgtgtgtgagagagaatgtgtgttttgagtgttagtgtgagtttgtgtatgtgtgaatattgtttttgtgtgggtgattttttgtatgtgtaattgtgtttttgtaagtgtgaataagtggataagtgtttgggagtggataagagatttgtgtattattaggtgtgtgtatagtgtttgtgtatgttaagagtgtaaggtgaagtgaagggattaggtttatgatgttatttattattaggagttttaaggttttaggtaagtgttagtgatagataagggtgttgaaggttattttggagtgggtaggtgggggtagggaaagggtaaggttatgttttggaggaggggttgtgattatattagggtgtatgagtttagttgggaggtggatggttgggtttattgagattttggttattttagaagtttgtgtgggtttggggagtttggagtggggagagggggtgatttttttgattaggtttttttattattttattttgggtaagggtttggagtaggaagtagtggtaaggatttttggagtagtttatatttgttttggtttgattttgttattggtagtatagttaatatagtaggtttatttatagtagagggtgaaggttattattagttttttttataagggaagggttatgtgtttggtgtgttgagagtgttttgtttggttttttgtgtttggtggggtgggggtgttaggtgtgtttagaggagtttagttggtagtgaggtagttatggggttagaagtattggtgtttttggttatgatagtggttatttttttgtttttggtggatttgatgtattggtattaatgttgggttgtatgttatttgttaggttttttgttattgtttgggttgggtaattttgttgtatgtggatttttagaatatattatattgttttgattaggtgagggaggaggttttggagggtggtagaggttttgaggatgttttattattagtaaatatgggtggtgggttaaattataggttggattagaagttaggttgagaaggggaagtaggtttgggggatgttttggggaaggatatttatatatggtatgaaggattggattttttaaaggttaaggaagagtagggtaagggtttggaggtggagttggatttggtagtgggtatgtaagtttattgggtaatatatgttatggagtataaagttttttttgttgatattagaaggaaaggttttgggaatggaagatgagttagttttgagtgttgtttaaattatgaaattgaggatgaagggggtgtagtgatttggtttaaattttttgtattgtgggtttttgggttttattgtttattggtatggattattatttgggaatgggatgttaattggggttttttggtaattttggtgatttttgtaaggttatatttgggtgatgtatttaaattgagtttttttattatagaaggtgtgatttttatttttgttttaggattaggaggttgggttttttttttttatttgtttatttttggtagttttgggggttgtttaaggtttaaataggattaggatttgtagtttggggtgattttggtttgataagaggttttgattttttttttgtagttgtggtgttgttttggggatgtgtttagtttgtagttggtttggatgttggtggttgtgtttaatgggttggtggttgtgtgtgaggtgatggtgatttgtggtgaggatatggttgattgtttgtttgtgtttatttattaggttttgggttttgggttgtgtttttaaggtaagtggtggtgggggatagagattgtgtttttgtgggttttgggtggatagtgattgtagtttaagtagtgttgatagggtgtggggttttggatgtgaaatagagataaaggttagtgagtgggttgaggatagtgggttaggaaattatttgtatgggggaggtgtgagtttgtgggttgggagggggtggggttattgtttagatttgttagaagtttggtgggtgaggttgatgtgttgaagtggtggtggtggggattgtgtttatgttgtgggtttagtgtgggtgggatgggtgggattttttttgagtggaaaggtggttagggtgggtagagatgaggtggggttaaattttgttttaggtaggggagtaatgtgggtgagtaaagagtgggttttgtgtttagttggattgggttagggattgtgggagattttgtggagtgttagggttggagtgggtggtggagggtggggttaaggtttttatggtaatgtttatgtgtttgttttgtttttaggggtgattttgttgtgttatgggtttgtgtggtgtgagtagaggtgtttttttgtgtttattttgtgtaatttgggtttgggtaagaagttgttggagtagtgggtgattgaggaggttgtttgtttttgtgttgtttttgttgattaagttggtgggtgatgggtagaagggtataaagtgggaattgggaaggtgggggatggagaaggtaattttttatttgtattttttatttttaggatgttttttttgttttaatggttttttggataaagttgtgagtaatgtgattgttttttttatttgtgggtgttgttttgagtatgatgatttttgtttttttaggttgttggatttagtttaggagggattgaaggaggagttgggttttttgtgtgaggtgtggagtgagagattgaggagtttttgtagggtgagtttttgagaggtgttggggttggattggggtttttgaagggtaggatttgtatagatgggtttgggaaaggatattttaggagattttattgtaagaagggtttggaggaggaggggatattttagatatggttgtgggagaggtgtgtttgggttagggggtattaggagaggttaaggattttgtatttttgtttatgttggagattttgattttaggttttttttttgggtaaggagagagagggtggaggttggtatttggggagggatttggtgaggttagtggtaaggataggtaggttttgggtttttttggagatggttggggtttgagattggtttaggtgaatgtagagtataggagggattgagattttgttttgtttggtgtaggtgttgaatgttgtttttgtttttttgtatattttagtgttggttggtaaggttttatgtttttaaaaggtttttttgatttagttggatgagttgttaattgagtataggatgatttgggatttagtttagttattttgagatttgattgaggtttttttggtaaagaaggagaaggtgagagtggttgttatggtggggggtaagggtggtgggttgaatgttttaggaggaatgaggggaggttgggtaaaaggttggattagtgtattatttggtgagttgtatttgggttgataggtgtagaattggaggttatttgggggttattttgttttattttttgagtatttttttggttttgtttaggttaaggggagttttgagagtagttttaatgatgagaatttgtgtatagtggtgggtaatttgttttttgttgggatggtgattattttgattatgttggtttggggttttttgtttatgattttatatttggatgtgtagtgtgagtttagttggggtttaaggtagggattgagggaggaagggtatagttgggggtttttgggtttagttgggatatttggggtttttagtataggtgtggttaggtttttgtaagtttaattttttttaatataggaggaaggagagtgttttttgggtgttgatttattgtggggatgtatgtttgtttagtttgtgtttaataggagattgatgatgtgatagggtaggtgtggtgattagagatgggtgattaggtttatatgttttgtattattgttgtgatttatgaggtgtagtgttttggggatattatttttttgagtgtgatttatatgatattttgtgatattgaagtatagggtttttgtatttttaaggtaggtttggtgttttttttattttagtttagtattagtttttggtgatagttttagtatggttattgttaggtgggtttattttaggaattttggttatttagtttttaatgttattatattgattgtttttgtttggatggggggtttagagtataggtagggttggtttgtttatttagagttttagtttagtggggaagataaattaggatttgttagaatgttggaggatttagtgtttgtagggagagggggtagtgtgggtgtttttgagaggtgtgattgtgttttgttgtggggttggagagggtattgtggagttttttgggtgtaggattagttgatagagtttagttgtgtgttaggtagtgtgtgttttttgtgtgtttggtggtaggggttttagtattttagagtttagtttttatttttattttgtattttttgtttagggaatgatatttattattaatttgttattggtgttgaaggatgaggttgtttggaagaagtttttttgtttttattttgaatattttttggatgtttagggttattttgtgaagttggaggtttttttgttttttttagtaggtgtttgtggggagtttggttttttgtttttttttgtggagttttgtaggggtattatttaggagttaggtttattgatgttttttttttttttataggttgttgtgtatgttttggggagtttttggtttgtatggagtttttttttttttttatttttttgttgtagtattttagtttttttgtggttgttggatagttttggtttagttatttttgtgttgttagttttttggtgattttatttttttatgagttttgtgttgtgttttgttagaatggggtatttagtttttagtttgttttttagttagaggttttaatgtataataaagtaatgtggtagttttaatttgggttttttgtttatgtttttgttgggattattttttttagggtaattttatttttgttttatttttgtttattttattgtttggttgtatttgagatgggtatgttgaggttgagtagatgttagttatttttgtttataattttatgttttttattgatttaattttgattgtttagattggtgataaggattatattgttttggtatgtggggaaggggttagaatgggttgattagaggtgttagttagttttggatgtggtggagagggtaggatttagtttggaggtttatattttaggtttaatttagtttattttatattagggatagtagttttgttagtattattataatagttatttttttttatatatgatattttaaaatggaagataaattatgttagggagttatatgttagggttattttttagggtttagttggtaggtgttagaatattttttgggaaggttttaggaaaatttaggattgagttattgtttttagtttgttattttgtgtttaaaattggtgggtttttggttttattgattttaagaatgaagttgtggatttttatggtgagtgttatagtttttaaagatggtgtgtttagagtttgttttttttgatgttaaga

SEQ ID NO: 779 - DNA, 11001 bp, Artificial Sequence
  chemically treated genomic DNA (Homo sapiens)
ttaagttagatgttttttaattatttgtggataggttaggtatattttgagtttaattttattttataggtttaatattttggagttagaaagtttttaggtaaaaagtttgaagggggtttttttatgttattagatggatttttgtatttttagaagattttttatattaggaaagattaaagtattaaggtaattttttttggttttttgggataattttaggttttggtatgagtggtttggaagtttttgttttagttataatgtttatatatttttggaattgttttgtagggtttgttttttagtataattttttttttaagttttattgtagttatagtttattagttttgtttagtgataattaagaaattaagaattatgtatttatgtttatttttttagagttatttttttttaggataaagtttagggttttgttattgggttttgttaggagttgtagttgtaggggttgtttattatttaatagtttttgtaagtatattgtgaaggggaagtaatgattagagatagggttagttgtttagtttttgtatgtttaggtgtatgtgtatatatttttatatagggtagggtggggtgggaagtttattttggttgtgatgtttagtgtgtttaaagagtgtaaatttgtgggggttatttattattaagaatttttgtagtagggttttaatgattttatgtgtttttgtgtgtgatagtatatgtaggtgtttgatagtatttttgggtaggtaaaaggaagtgtggtgtttgatatttgtgttttgttttgggttttgttgggtattttgtaaggagggtggttttttgttggagggtatagagatagggtgtattagttttagttgaattttgatgaagtttgtgtaagaattgtttttgttttaaagaaatagagaaattaaattttgataataggttttaggtgagatgttagtttatttggggttaggttgggtatgtataaattattgtttgtgtttatttaagataattttagttgtgattttttgagtattaggtatatagttgggtatttgtttttttttatgttttttttttgagtagttaatttattaagtttatgaagaggttgttgttgatttgggtattgtattttttgattttttgtttaattttagtttgagaaaggttaggtgttttttattttataggtttgttttgtaagatgggttagtatggatatagggtttttgaggaatttagggtttttttgaaaaatggtttttggggtagtttttggaaattgattgtttttggttttttgtttttgatgtatatatatatagttggtgtttattttgaatttattattgtttttggttttgtatgttttgggtggataagggaaagatagaattatttggtttttttttgttgtttgtttagggttttagtattgaatgtagttttaaggatattatagaagtaggggtaattgaaggtatatggttaggggttaggaatagttgagggattttgaagagggatttttatttaaagtaaaattaggttgggtgtggtggtttatatttgtaattttagtattttgggaggttaaggtaggaggattatttgatttttaggagtttgagattagtttgggtaatatagtaagattttatttttattaaaaaaagaaaaaaaaaaattagttaggtgtggtggtgtgtttgtagttttaattgtttaggaggttgaggtgggaggattgtttgagtttgggagattgtagttatagtaagttattattgtgttattgtattttagtttggggaattgagtgagattttgttttaaaatataaaaaataaaaataggttgggtatgttggtttatgtttgtaattttagtattttgggaggttgaggtgggtggattatttgaggttaggagtttgagattagtttgattaatatggagaaattttgtttttattaaaaatataaaattagttaggtgtggtggtatatgtttgtaattttagttatttaggaggttgaggtaggagaattgtttaaatttgggaggtggaggttgtagtgaattgagattgtgttattgtattttagtttgggtaataagagtgaaatttggttttaaaaaaaaaaaaaattagtaaaattatattttaattgtatattttgattatagtattttagttgagttggagtgagggtttgttttggagaaggtagtttattttttttttttgttttggtatggggttatgatttattgtagggtgagaggagtggagagtggtgtatattagtagtttagttattagtggatagagtagtatttggagttagttttttatgttttatatatagtgagaaaaattattgtgatatgatgtttaattttgatttaagttgtataaaaggtagttttaggttaggttttaatttgttagaggtatataggtagttttttggtgggtttttgtatttgtttgtgttgtttggagatttggtttaaagattttttttttttttgagatgaagttttattttgttgtttaggttgtagtgtagtggttggattttggtttattgtaagttttgttttttgggtttaagtgatttttttgttttagatttttgagtagttgggattataggtgtgtgttataataatatttggttaatttttgtatttttagtagagatgggattttattatattggttaggttggttttgaatttttgattttaagtgatttgtttgtttttattttttaaagtgttgggattataggtgtgaattattgtatttgatttagagatttttaatttgattatttattttttattttatttagggattggatttttgttggaagggtggagtgtgggatagggtagttagggttttgaattgattttttttttttagatttttttggttttattgtattagttttattttttgttgatgttagataggttttagttagaatgtgagtgttatagatatagttaagtttagtgttgattaatattttgttttagaagaatttttataaggttttttgtagaatgattttgtgtttagtttaggagagttagggttttttttgattttgttttggagtttttttaagtatttaaattatttgatggggataaatggagaggatagatgagggagtagggtggagtgttttagtagaatgttttttatttagaatttgttgttattttgtagttagtaaggatgtggggttaagaattaaggttagggttttataggaaaaaggtaaagggggaggggtgggaatttaagtttatttttttttttaagtatttaaaggttttttggatggagaagagtattggagtaaaaattttagtataaattttattggggatagtgggtaattttgttgggttagtaaaaataaatggtgtgggttttggaaaatgagggttggaggttgtgaataaagtagtggatgtgtttgtttagtatattaatgggaagaagtatttagatgggaggagtattaggggtaggagaaatgttagatagattttagtgttagggtaagaaggaagattattttgtttgtagaatagggagggtatagggatggtgttaatttgtttttgtgatggttttgagtttttatttaataatgagaaagtttgtttttttttttttttttggatgatttaggagttttgggttgggatgtagtgattttatttttagtttttttttttttggtgatgaatttttttatttttatttagaaaatagatttggattagaggtattgtatagtttttttaggattttaaaggaggaagagtttttttttttgtttttaaagttgtttgttggaagaggattttaatagttattttagttggatgtatagtaggattatggaattttttttttgtattatagggatttattttttattttattattgtttataaaaattgatggttttttttttgagatagagttttgttttgttttttaggttggagtgtagtggtgtgattttggtttattgtaatttttgttttttgggtttaagtaattttttgttttagttttttaagtagttgggattataggtgtttgttattataattggttaattttttgtatttttagttgagatggggttttattattttggttaggttggttttgaatttttgattttatgatttatttattttggttttttaaagtgttgggattaaaggtgtgagttattgtatttggtttaaaattgatgtttttttttttttttttaatatataatttgggattttttagttttttattttttttttttttttttttttttttttgagatagagttttgtttttttatttaggttggaatgtagtggtttagttttgatttattgtaatttttgttttttgggtttaagtgatatttttgttttagtttttttagtagttgggattataggtatatattattatggttagataatttttttgtatttttagtatagatggggttttgttatgttggtttggtaggttttgaatttttggttttaagtgatttgtttgttttggttttttaaaatgttgagattataggtatgagttattaagtttagtttttttttttttttttgagatagagttttattttgttatttaggttggagtgtagtggtatgattttggtttattgtaatttttgttttttggttgaagtgatttagttttttaagtagttgggattatagttatatattattatgtttggttaatttttgtatgtttagtagagatagggttttattatgttggttaggttgattttgaatttttgattgtaaatgatttatttgttttggttttttaaagtattggtattagaggtgtgagttattgtatttggtttttttttttatttttgagatagagttttattttgttatttaggttggagtgtagtggtatgattttggtttattgtaatttttgttttttaggtttaagtgatttttttgttttatttttttaagtagttgggattataggtgtgtatttttgtggttagtttttttttttaattggttagtgttttgtggtttttttatttttttatagtggaaaatggtttaggattgattgatatgaagataagtttaggggtttatatttaatttaatttttgtatttaagttttgggttaagattttggtgtgttgagtattatttattttgtaaggaattttgtaaaattttatttgaagtattatttataattttattttttttatttaaataaggatttttgttttatttttgttaggtatattgagttttatagtttttgttttttttttttggtgtttaggtttggttttttgagtttggtggttatattaatggtatttggtatatagttttttgataatggggatatttaggaggttttgagatattttatagttttgggttagtaatttggatttttttttttatttttttaggtattttataatttagttttttttttttttgtgggtaaagtgtttttgaatgtttatggtttaaaataagattttttttttatttatttttaaatttttttttagatttattttagaggaagggaatagaattttttatattttagtagttggtgataggttagaatagggaagaggtgagggtttagttggttttatataggagtgtagatggaggagtaggatttttttttgttttttaagtttttttaaatatattttttaatttttggtgaggatttttttttttttatatttttttttagtttttttaaggagggagtaggagtatttgaatgtggaaattgaggtgttagtttaaattgtttggttggttttagttatagttggataatgtttggtttaggtttattataagttatatagttgttttttttgtgtttaatttgtttgtgatagaaattaagggggttttggtatttagtatttaggtggtggaattggggttttatgtatggttttgtgggtaggtttttggttaggatttgtggggagttatgtagttaggagggtggggttgtttattgatttaggatgtggtaatggattggggagggtggagttttagtgattgtttttttttttgtttgttggtattttttggtttttatttggttttggtgtggtttgtgagttagtgaggtttgtgtggtgaagtattgtttgagttttgagtttgagtttttttggttgtagtagttattgtttgttgtgttgttttaggttattttgaaagaaggtgtttttgttttgtttatagttgtatttgtttgttttttagttttgtgtgtttgtagttgttaattattgttttggttgtgtgtgtgtgtgtatgtgtgttagtgtgtgtgtgtgtttgggttagagttgtgttgtaattgttaagattgaaatgtagattgttgggatttagtttttgttttattggggtaggaatgttggggtggggatatgtatgttttgtttttaggaatgattttattgttttggagttttatttatagattttatttattatagggaatgggggtgggtgttagtgtttgggtaagtgtataagagtggtttttggttggaggtgagggtgggaaggtgtgggaagtgtgtgtgtgtggagtttgggttagtttgggtttgggtttgtttgtagtgggtggagtatttgtggagttggtaatttaggttttttttttagtttttgtgtagaattagtttttttgtgttgttgggaaattggtaattagaatgttttttgtgtgtggtatttaggtagtttttgagaatgtttgtattgtggtttgtttatttttgttttttttatatgtttttggttttgtgtttattatgtttgtgttttgttttattgtgggtttttagtttaggttttggggtttgtaatagtttaggtagatgagtgtgtggtagtggtagtggtaggtgaatttgtaatttgtagagaggtttggtggtgaggtggaggagttttaggttggggaaatgttttggagattgaagggaagttttagggagagggttgttgtttgttaggttttgtaggtttgatttattttagtgggttattttatattgttatgtggattttaatgttggttatttgggtgtttggaaattggttggaaggttataggtagagaggtttgtttaatagttggatttttattgtttagtatagaattttttttttttttattggtaattaaaaaaataataataaaaaattgtgttttgtttttgttatttaggttggagtgtaatggtgtgattttggtttattgtaatttttgttttttgggtttaagtgatttttttgttttagttttttgagtatttaggattataggtgtttgttattatgtttagttaatttttgtatttttagtagagatggggttttattatgttagttaggttggttttaaatttttgattttaggtgatttatttgttttggttttttaaagtgttgggattataggtttgagttattgtatttggttttttattgggaatgtatatggaatatatttgtttatttatttgaaggaaaaattaaatatttttaatttatgtttgttttgtggttgttatttgtttttattttttttagattaagatattggtttttatatattttaattttttgtttttatttttttttttatttattttagttaggtttgtttttttttttaggaaattgtttgggatagggtttttagtgatttgtgtattattaaatggaatttagtgttttattttttatttttatttttttagtattatttgaagtttgttttttttgatttttaggggttatatttttttagttttttttttattttttgtagtttttgtttagtttttttgtagattttgatttaatttttatattttatgatgaagtttgggtttagttttgattattggtttggtttgtttatatttatttgttttagatttatggttgaaatattgatttaaatttttagattagattttttgtgttagtatttttattaggatgtttaaaagatgttttaagtgaatatggttaaaatttaatttttttttttttagttttattgttatatttgtttagttttttttttgtagtaaaaatggttattaggtttttagttattggagataaaagtttaaatttatttttgattttttttttgtttttatttttgataaatatgtttaaattattttgttttttatttttatggttattttatttttttttgagaatgttgtaatgttttagttttgttttttttttttttttttttttttttgagatagagttttattttgttgttaaggttggagggtagtggtatgattttggtttattgtaatttttgttttttgtgtttaagtaatttttttattttagttttttgagtagttgggattataggtatttgttattatgtttggtttatttttttttattttttagtagatatgaggttttattatgttggttaggttggttttgaatttttgattttaggtgatttatttgtttttgttttttgaagtgttgggattataggtatgagttattgtgtttggttttttgtttattttttgtattttgttataattttgtgttttttttagttgaatttgtgatgtttttttgtattggatgagagggtttttatgtatatatagatttgggatattatttatttataagtttttaaataggttagagtagtgatgtttaatttagattttatgttataataatttggggagtttttaaaatttattgatgtttagggtttatttttagtagttgatttaataggtttgtggtgggatttaggttagtggggaggattgtaaaagtatttttggtgattttagttggtgtttatttaggggagagtaatttttgtttgttggtgatttttaggggtgtagaaggattgttgggtgtgtggttgtgtgtatattttagtatttgatttattgggttagaaaagggtgtttgttaaataaagatttaataaaatttttgtttgtagggggtttattaaaggttttaaatttttttaggtttttttttataggtggtaatttttttttattttaaaggttttggagggggttatgagtgtttgagaagaggtaagtttgggaagatggattttgaggatagtaggtataaatttttttttaagaagggttaaggtattttaaagataagaaatttaaaattagtgtatttttatatataagtagttatttttgtttatttgtggtttagatatgagtggagtgtgataagggataaattatttttgtgtattttttagtgatggggtgaaagtaatggatttagtttttgggagttgtttttgttgattttttttgttgtgatttgatttgtggtgattgtgttgttttttggttgttttttttgtttttgtaggtgtgtggggttattatttatgtgtgtattgtaggtttttgtgtatgatgttttagatgaagttgttatagaggttgtattatgtgtgtgtggtgggttttgtgggttggaagtggtggttatggttagggattagttgttgtgtggggttgtatgtggtgttttgtgtgatgtgtagtgtgttggtatgttttagttgggtgtggttttttttagtgtgtttagtgggtgttagtttttgtagtttaatgagtttaggtttttttgatatggtttggttgggtttgtgttttgttggttttgggtgttagtaagtgtgggttgggtggggttatagggtgggttttgattttagtgttttttttaggatttagattgggtggtgggaaggagttgaggagagttgtgtaatggaaatttgggtgtagggattgtggggtttgaaggtggggttgggtgtgtttttgtagagttttttttgttttgttttttttttttttttttgttttttttttatattttattttggatggttataatgatggtgattgtaaagtattatgtggagatatttgtgtttttggaggttagttttattgtgttagaggaagagggtttttatatttggttttggtttttttggtttggtttgttgaagtaatatatttggtttatttattgggtggggtaggaagttttgagtttttatttggggtgaggaggagggagattggttagtagttttattgtttgttttgttttttattgtggagattggggttttggtagaggttggattgtgattttgaggtttaggggtgtattttgggtggatttttttggtatgggtggttggtttttagtaattgtagtttttatttggttttgttattttgggttgttaggatataagtttttttatgttttttttagtgtttgatttggtattttttgtaggtaggtgggtattgaggatggtaatgtatgtgggggatgtgggagtagggtttagaggtttaaggttttaggatatttttatttgtagtaatattatttattttggtattgtgagtagtgtttagaagtttttgtattgtagtaagtatagtggggttgttttggagttattgtttttagtatatttagtttgtaggttttagtttatttgggggaaagttaggaaggtttgattggttttggaaggtgggggtattttatttatatttatgttttttgtattttttttattttttttgttatttttataggttttatttttgtgtttgtagttgtaggttttgttttgaggggttgaatatatgttggagttggtgtttggtaattgtttgttatttgtttttgtttttttgttttagttgtttttagatttttgggatttagga

SEQ ID NO: 780 - DNA, 11001 bp, Artificial Sequence
  chemically treated genomic DNA (Homo sapiens)
ttttagattttagaaatttgggagtggttggagtgagaaaatagaggtaagtggtaggtaattgttaagtattagttttagtatgtgtttagttttttagagtaggatttgtggttgtaggtgtgaaggtaaggtttgtggaaatggtagggagggtggaggggatgtaggaggtatggatgtgggtggggtgtttttattttttagggttagttagatttttttgatttttttttaggtgggttgagatttataggttggatgtgttagaggtagtggttttagagtggttttgttgtgtttattgtagtgtagaggtttttaagtgttgtttatgatgttagaatgagtggtattgttgtaggtgagggtattttagaattttggatttttaagttttatttttatattttttatatgtattgttatttttaatatttatttgtttgtagggagtgttaagttaagtattgggaaaagtatggaaagatttgtgttttggtagtttagggtgatagagttaaatgagggttgtagttgttgagggttgattatttatgttaagggaatttatttagaatgtatttttgaattttaagattatggtttagtttttgttggagttttagtttttgtagtggagagtagagtgggtggtaaagttgttgattgattttttttttttttattttaagtgaaggtttgagattttttgttttatttagtgggtaggttaagtgtgttgttttagtaaattggattaggagggttagggttggatgtggggattttttttttttagtatagtaaagttggtttttagaaatatgggtatttttgtgtggtgttttgtggttgttgttgttgtggttgtttggggtggggtgtgaggaggggatgaaggagggaaggaagggtaaggtggggggggttttgtgagagtgtgtttagttttgtttttgggttttatagtttttgtatttaggtttttattgtgtggttttttttagtttttttttgttgtttagtttggattttgggggaggtgttgaagttggggtttgttttgtggttttgtttggtttgtgtttgttagtgtttaaagttagtgaagtatgggtttaattgggttatgttgggggagtttgagtttattgagttgtgggagttggtatttgttgggtgtgttgggaagggttgtatttggttggagtgtgttaatgtgttgtgtattgtgtggggtattgtgtgtaattttatatggtagttggtttttggttgtggttattgtttttagtttgtggggtttgttatgtatatgtggtgtgatttttgtggtgattttatttggggtgttgtgtgtaaaggtttgtagtgtgtgtgtgagtagtggttttgtgtgtttatgagagtggaaggggtagttaaggggtagtgtagttgttgtgggttaagttgtggtagagggggttggtggggatagtttttgaggattaggtttgttatttttgttttattgttgaagagtgtgtgaaaatggtttattttttgttgtattttatttgtatttgggttatagatgagtagaggtggttgtttatatgtaaaaatatgttgattttaagttttttatttttaaaatgttttggttttttttgagaaagggtttgtgtttattgtttttggagtttatttttttaggtttgtttttttttaaatatttatgattttttttagaatttttagggtgaagggaaattattatttatgggagggagtttggaaaaatttagaatttttggtgggttttttgtaagtaggagttttgttgagtttttatttagtaaatatttttttttgatttagtgaattagatgttaaaatatgtatgtagttatatatttagtagtttttttgtatttttgggaattgttagtaagtaaaggttgtttttttttgggtagatattagttggaattattaggggtgtttttatagttttttttgttagtttggattttattgtagatttgttgaattaattgttgggagtggattttaggtattagtaaattttaaaaattttttaaattattgtaatatggagtttgggttgagtattattgttttggtttatttaggaatttgtggatggatagtgttttaggtttgtgtgtgtatggagatttttttatttggtataagaggatattataaatttagttggggggagtataaagttgtgatagaatgtaaagaatgaataaggggttgagtgtggtggtttatgtttgtaattttagtattttggaaggtggaggtgggtggattatttgaggttaggagtttaagattagtttggttaatatggtgaaattttatgtttattaaaaaataaaaaaaaatgagttaggtgtagtggtgggtgtttgtaattttagttatttgggaggttgaggtgggagaattgtttgaatataggaggtggaggttgtagtgagttgagattgtgttattgttttttagttttggtgatagagtgagattttgttttaaaaaaaaaaaaaaaaaaaaaaagaataaggttgggatattgtagtgtttttaaagagaaataaagtagttatggagataagaagtaggatgatttgggtatgtttattagaggtagagataagggagaaattaaagataagtttgggtttttgtttttagtaattgggagtttagtggttatttttgttgtaaagaggaagttgggtaagtgtagtagtgaggttgaagaaaagggaattaaattttggttatgtttatttgaaatgttttttagatattttagtgaaggtattggtatggaggatttagtttgagggtttaggttagtgttttagttgtggatttggggtagatgaatgtagatagattaggttagtgattaggattgagtttagattttattgtgagatatggaagttgagttagaatttgtaaaggagttgagtaggagttgtagggggtaggaggaaaattgggagagtgtagtttttgggagttaaagggagtaagttttaaatgatgttgagggggtgagaatggagaatggaatattggattttatttggtagtatatagattgttgaggattttgttttgggtagttttttggaggaagaggtaagtttggttggagtgggtagaggggagagtgaaggtgaaggattagagtgtatagagattagtgttttggtttgaggggagtagagataggtgataattatagggtagatgtaggttaaaggtgtttagttttttttttaagtaaatgggtagatgtattttatatatgtttttagtgaagggttgggtgtggtggtttaagtttgtagttttagtattttggaaggttgaggtgggtggattatttgagattaggagtttgagattagtttggttaatatggtgaaattttgtttttattaaaaatataaaaattagttgggtatggtggtgggtgtttgtaattttaggtatttaggaggttgaggtagaagaattgtttgaatttaggaggtggaggttgtggtgagttgaaattgtgttattgtattttagtttgggtgataaaagtaagatgtagttttttgttgttgtttttttaattgttaatgaggaaaggggaagttttgtgttaggtgatagagatttaattgttgagtaggtttttttgtttgtggttttttggttggtttttagatgtttaggtggttaatattagagtttgtgtagtagtgtgaggtaatttattgagataggttgggtttgtggagtttggtgagtagtggttttttttttggggtttttttttaatttttgggatatttttttgatttggagtttttttgttttattgttaggtttttttgtagattgtaagtttatttgttattattgttgttgtgtgtttgtttgtttggattgttgtgggttttgggatttgggttgggaatttgtggtggagtgggatatgaatgtggtgagtgtggggttgagggtgtatgggaagggtgaggatgggtaggttatagtgtaggtatttttgagggttgtttgggtgttgtgtgtaaggagtgttttaattgttgattttttggtggtatagagaggttaattttgtgtgggggttgggaggggagtttggattgttggttttgtaagtattttatttgttgtaagtggatttgggtttaggttgatttaggttttgtgtatgtgtattttttgtatttttttgtttttgtttttggttagaggttatttttgtgtgtttgtttggatgttggtatttgtttttgttttttgtggtaggtggggtttgtgagtggagttttggagtgatgaggttatttttgggggtgaagtgtgtgtgtttttgttttggtgtttttgttttaatgagataagagttagattttggtgatttatgttttagttttaatggttgtggtgtggttttggtttgggtgtatgtgtatattgatatgtgtatatgtatgtatgtgattggggtggtggttggtggttatggatgtgtaggattgggggatgggtgggtatggttatgggtgaggtggaggtgtttttttttgaaatgatttggagtagtatgatgagtagtggttattgtagttaagaggatttggatttggagtttgagtagtattttattgtgtgaattttgttagtttgtaggttgtgttgggattaggtgggagttagggggtgttggtgggtgggaggggaagtggttgttggagttttgttttttttggtttgttgttgtgttttgggttggtgggtagttttatttttttggttatgtggttttttgtgggttttggttggggatttgtttgtggaattgtgtgtaagattttgattttattgtttagatgttgggtgttggggtttttttggtttttgttatagataggttgaatatggaaaaagtagttgtatggtttgtggtagatttgagttgggtattatttagttatgattaaagttgattgagtagtttggattagtattttgatttttgtgtttgaatgtttttgttttttttttggggagattaggggaggatgtggagagggaagagtttttgttaggaattgagaagtatgtttaggaaaatttgagaggtagagagagattttgtttttttatttgtatttttgtatggagttagttgagtttttattttttttttgttttggtttgttattagttgttggaatgtggaagattttgttttttttttttagggtggatttggagaaagatttgggaatagataggaaagaagttttgttttggattataagtatttaggagtattttatttataggaagggggaaagttagattataaaatgtttaaagaggtggaaaaagagatttaggttattaatttaggattgtaaggtgttttggaattttttaggtatttttattattggagaattgtgtgttagatgttattggtgtgattattaggtttagagaattaggtttaggtattaggaaaaagaaatagggattgtgaagtttagtatgtttggtagaaatggggtggaaatttttatttaagtaaagaaagtggagttgtgagtgatgttttagataaaattttataaaattttttataaaatgggtggtgtttagtatgttaaaattttagtttagagtttgggtgtaagggttgagttgagtgtagatttttgggtttgtttttatgttagttagttttgagttattttttattgtggaaaggtgggaaaattataagatattaattaattgaaaaggagggttagttatggaggtgtatatttgtaattttagttatttgggagggtgaggtagaaggattatttgaatttgggaggtagaggttgtagtgagttaagattgtgttattgtattttagtttgagtgatagagtgagattttgttttaaaaatagaaaaggaagttaagtatggtggtttatatttttaatgttaatgttttgggaggttaaggtaggtggattatttgtaattaggaatttgaggttagtttggttaatatggtgaaattttatttttattaaatatataaaaattagttgggtatggtggtgtgtgattgtagttttagttatttgggagattgaattattttaattgggaggtaaaggttgtagtgagttaagattgtgttattgtattttaatttgggtgatagggtgaggttttgttttaaaaaaaagaaagaaggttgggtttggtgatttatgtttgtaattttagtattttgggaggttaaggtaggtagattatttgaggttaagagtttgagatttgttaggttaatatagtaaaattttgtttgtattgaaaatataaaaaaattatttggttatggtggtgtgtgtttgtaattttagttattggggaggttgaggtaggagtattatttgaatttagaagatagaggttgtagtgagttgagattgggttattgtattttagtttggatgagagagtaagattttgttttaaaaaaaaaaaaaaaaaaaaagaaagaataggaggttgagaagttttaagttatatgttaaaaaaaaagaaaaaaatattagttttaggttaggtgtagtggtttatatttttaattttagtattttggaaagttgaggtgggtggattatgaggttaggagtttaagattagtttggttaaaatggtgaaattttgttttgattaaaaatataaaaaattagttagttgtggtggtaggtatttgtaattttagttatttgggaggttgaagtagagaattgtttgaatttaggaggtagagattgtaatgagttaagattgtattattgtattttagtttggaaaatagagtgagattttgttttaaaaaaaaaattattagtttttatggatagtggtagagtggagggtgggtttttatggtgtagaagggaaattttatggttttgttgtgtatttgattgggatggttgttgaaatttttttttagtaggtagttttggaaatagaaaaagaaatttttttttttttagaattttggaagggttgtgtagtgtttttaatttaagtttgttttttgagtgaagatagggaggtttattattagaagggaaggggttggaaatgaggttattgtattttagtttagggtttttgggttatttaggaagggaagaaggagtaagtttttttattgttaggtaggagtttagagttattataagaataagttagtattatttttgtgttttttttgttttgtaaataaaatgatttttttttttgttttggtattagagtttgtttggtattttttttgtttttagtattttttttatttgggtatttttttttgttggtgtattgaataaatatatttattgttttatttatagtttttagtttttattttttagggtttatattatttgtttttattaatttgataaggttgtttattgtttttagtaaggtttgtattggggtttttattttagtgtttttttttatttaggagatttttggatatttggggaagaaaatgagtttaaatttttatttttttttttttattttttttttgtaaggttttggttttagtttttagttttatatttttgttggttgtagaatagtagtgggttttgggtaaggagtattttgttaaaatgttttattttgtttttttatttgttttttttatttgtttttattagatggtttaagtgtttaaggggattttagggtggagttagggagaattttggtttttttgggttaggtataagattattttataggaaattttgtgggaatttttttgggataaagtattggttagtgttgagtttagttgtgtttgtgatatttgtattttaattagggtttatttgatgttaataggaagtaaggttgatgtagtggggttaagggagtttgggagaagaaagttggtttagagttttggttgttttgttttatattttatttttttggtaagaatttagtttttagatgaggtggggagtgagtggttgagttaaaaatttttgggttgggtatgatggtttatgtttgtaattttagtattttgggaggtgaaggtaggtggattatttgaggttaggagtttaagattaatttggttaatgtggtgaaattttatttttattaaaaatataaaaattagttgggtgttgttgtggtatgtgtttgtagttttagttatttgggagtttgaggtaggagaattgtttgaatttaggaggtagaatttgtagtgagttaagatttagttattgtattatagtttgggtgatagagtgaggttttgttttaaaaaaaaaaaaaatttttgggttaaatttttagatagtataggtaggtgtagaaatttattaggaagttgtttgtgtatttttggtagattggagtttggtttaaagttgttttttatgtagtttgggttaaggttaaatattatgttatagtgattttttttattatgtgtgagatatggagaattggttttaagtattattttgtttattggtggttggattattgatgtgtattattttttattttttttattttgtagtgggttatggttttgtgttggggtagaggagaaaaatgggttgttttttttaggataaatttttattttaatttaattagggtgttgtgattagaatgtgtaattgaggtgtgattttattgattttttttttttttgagattgagttttgtttttgttgtttaggttggagtgtgatggtatgattttagtttattgtaatttttattttttgagtttgagtaatttttttgttttagttttttaagtagttgggattataggtatgtgttattatgtttggttaattttgtatttttagtagagatggggtttttttatgttggttaggttggttttaaatttttgattttaggtgatttatttgttttggttttttaaagtgttagaattataggtgtgagttaatgtgtttagtttgtttttgttttttgtgttttgaagtagggttttatttagttttttaggttggagtgtagtgatatgataatagtttattgtagttgtaattttttgggtttaaatgatttttttattttagttttttgaatagttgggattataggtatattattatatttggttaatttttttttttttttttttagtagagatgaggttttgttatgttgtttaagttggttttaaatttttgaggattaagtgatttttttattttagttttttaaaatgttgggattgtagatgtgagttattatatttagtttgattttattttaaatgagagtttttttttagagttttttagttgtttttggtttttggttatgtgtttttagttgtttttgtttttgtggtatttttaaggttatatttagtgttgaggttttaggtaggtagtagagagaagttaaatgattttgttttttttttatttatttagagtatgtaaaattaggagtagtggtgggtttagggtgggtattagttatgtatatgtatattagggatagggggttaaaggtagttagtttttaaagattgttttagaggttattttttagagaagttttgggttttttaagggttttgtgtttatgttggtttattttgtaggatgagtttgtggagtgggagatatttgattttttttaagttgagattgagtagaagattaaggagtataatgtttagattaatagtaatttttttatgagtttggtgagttgattgtttaggaagggggtgtggggaggagtaggtatttagttatgtgtttgatatttagagggttataattgaggttattttgggtgggtgtaagtagtaatttgtgtatatttagtttagttttaagtagattgatattttatttggaatttattattaaggtttggtttttttatttttttagaataaggatggtttttatataggttttattaaggtttagttgaagttggtgtgttttgtttttgtgttttttagtaagaagttattttttttgtaggatgtttggtggggtttaggatggggtataagtgttaggtgttgtatttttttttatttgtttaaggatgttgttaagtatttgtatgtgttgttatgtataagggtatgtgaagttattgaggttttgttgtgaaagtttttggtggtggatgatttttgtaagtttgtattttttgagtgtgttgagtgttatggttaaggtgggttttttattttattttgttttatgtgagggtatatatgtatgtatttgagtatgtaggggttgagtagttggttttgtttttgattattattttttttttatagtgtatttgtggaagttgttggatgatgagtagtttttgtggttgtggtttttggtagggtttagtgataaggttttgagttttgttttgaaggaaaatgattttggggaggtgaatgtgagtatatagtttttagttttttggttgttattagataggattgatgggttgtagttatagtaaggtttggaggaggaattgtgttggaagataagttttgtaaaatagttttaggagtgtataggtattgtaattaaagtaaaggtttttagattatttatgttaaagtttagggttgttttaagaagttaggaagaattgttttggtgttttgattttttttggtgtggaaaattttttggagatgtaggagtttatttaatgatatgaggaggttttttttagattttttatttggaagttttttggttttaaggtattaggtttgtggagtgaaattagatttagaatatgtttgatttgtttataggtaattggggaatatttgatttgg

SEQ ID NO: 781 - DNA, 4001 bp, Artificial Sequence
  chemically treated genomic DNA (Homo sapiens)
atgtttagttaatttttgtattttttagtagagatggggatttattatgttggttatgttggtttggaatttttatttttaagtaatttgtttgttttggttttttaaagtgtaggtgtgagttatagtgtttagtttgattttattttatatgaagttttttaataggtaaaatggttatggagattaaaataaaggtggggttgggaattgattgggaagagatgtgatgaaatgtttttgggatgatgaaaagggtttgtgatttggtaggtattatggagtggttaggggttaaaatttatttttttgtgtatttgttgtgtgtattggtgttgtgtgtaaatgttattttgatttaggaaaaagatgatgtaagtatggtataaagtggttggtatgtggtaggtgtatgggaagaaattgtggaatgaaataattgtgagttaagagatggggtagtgggagaaatgaatttgagttttgttttttattaggaagaattggtttgggttggagggttgtatggaggattatatggatgtttgtgggtttgttttttttgttttatgatgtttagtttgtgtttggaattggaatggtttagtttaaagttagataataggtagattgtttttttgataaattattaaatgatttattattgtatttttttaaaatttgatttttagatgtatttatttttttttttttttttttgggaagatgagatatatttatttttgaaaatatttttgggtttgttttttgtatatttttttttttttttgttttatgttatggtagtgtttgtttaggttgtaggtgatttgtggggtggggtatattatttaaagaaggggagggattgaggtttgtattaaaataaatatttttgtttttgtaaaggttataattaagtaatttagaaaaagaaatgtaggtggagaatagtagtttttttttgttaagtaagaggaattggtttaaaggatatttttttttttttttttttttttttattgggtgaatagtgagttgttttggtaaaaagaaattggaaatgttgttgtaagaggtagaaatgtaaatgtggagttaaataataatagggttgttgggttttttagattgtgatggttttttttggtttggtgggtaaatttttggtttagtattttttatttttatgattgatagtttttaattggattttttttatttagtggagttgggggttgtttggaaagattgttttaggaaggataaaggtttggaagttgtgggattttagtagtttgggttttttggattatttttaaatgattattttggaatggagttttagtttttattaggatgttatgggttttaaaatatatagttatgagtttttaatgttttgagatttaaaagttttagattttaatgttttgtgtattttttattttagggattttttatgtttagtattgggtggatgtgtaaagaagtatgttttaggttggtttaaggttttttaaagttttatttttttgtttaggtgtttaattttgagtttggatggttttaatatttttattatttatatttaggttttttaataatgtaatttttatgatgatttttttagttaagtttttattttatttatttttaaatttgttaagtttttattgttttatttttagttttagtgatttttttgagttgaaaatatatggagttgagagtttgtgatttagagaggatttattaagtttagttaggagtttatttaatttagggaagtgtgttattgttgtggaaagtatgtttttagtttgaatgtaaagtgtttttggagtttagtagttatttgttttttggatggtggttttagatttttgagaagtttaaaatttttagtgttagttttgagtatatgggaggggaaaattttaattttattaatttttgtgaggtttttggtataaagttggatagttgttatgataagtaagggtaagtaatttgtttgttggaggaagtaaaggaaatggagttggggaggagggtgtagagttaggatttttgttgatttggtgttgtagatattaatattttggggtggaaaattttgtaagttagagttgtgagggtagaattggtggaaattattttggaggaattttgtattgtgttaaatatgaagggtggaaggaagaaagtttttgtgtttgtttttagttggattttttttttttattagttaaaatgttattttttaggaaggttttttgtaatattatattttaatgtttttttttagatattttatattatattattttatttaattttttttataatttttattattttgataagatttatttgtttattgtttttagtatatggaaatgtaagttttatgaggatatagaatttttttattattttatttattgttgtatttttgagtgtttatattagtgttgggtagtaagtaagagtttgataataaatattttttgaatgagggagataggtttgaagtttggagaatgagatgtagaagaggtgtaagatttgttgtgttttttgtaggtggtgggggggtggtgtaggtgttttaagaattattgtgggatttggtagggggagtgtaggtgttttttgttaagatagaagtgtttagattataatttttagtagttatgaggagttttagggtttgatgggaatgggaaattttttaattttttatgttttggttttgtgggttttgtgggttgtttgtgaaatttgatttgggatgtggtggtttaattggaaggtggattgaaattttgtgatagtaagaggtttgtagtgatttgtggtgttaaggaatatagtgtttttaaaagaattggtgtttgttgtttgtttttttttttgggagttttttgtttatttttagaagaggagggaagtataggtgggtttttttagttttgtgttggatttttgagaattttgaagttattttggttgaggttaatttttgttgtgttttttttgtagtatgaagattttggagatttaattgttagttttggattgttgttttttagattaggatttagttttagtttatttttttttttatgtttttttgatgaataaaaatgtggattttgaattgatgttattgttttttgaaaggggggatttgttttggttgtttttagattttgtggttggtttagttgtgttttaggagttatgggagggggatttagtttttttttttatttttttggaaatagagtttggtttttttagtgagttgagtttttgaattgaggagtaagaattttttgaaaatataagtttttttgtagaagaagtaaatgggagtttttttgaagaagaagtgaatgggttagagttggggtttggaaaagttatggaagatatttttggggaatttgttgtagaggatgagggagatatgtaagtggtgatggtagtggagtgtggagtttggggagatgaagtgtgaggttgatttgttttttggttttgagatttatttttttaggtttttgttttttttgtttggtgatttaggtttattgttttttattttttttttagtgtttggaattatagttttttttagttgttttgattttttagtggtttttggttagagtttagtatttaatttgagaattttttgaaaggttgtaagtggtaaggataataatggggtagggagttgattatttttgagatttttattgtaaaatagtttagttttttaggagagggatgttttagagttgggagaagtggtatgtagtttttttagattgagtttatattttatttagtagtttgtgttttttattttttttaaggatttaggggggtttatttattttagaggtaggtttagttttagttttatatttgaaaagtataggtttggttagttttttaatttttttttgtttttagggtttttgatg

SEQ ID NO: 782 - DNA, 4001 bp, Artificial Sequence
  chemically treated genomic DNA (Homo sapiens)
tgttaggagttttagaaataggggagagttagaaagttggttagatttatgttttttaagtgtagggttagggttgagtttgtttttggggtaggtaagtttttttgaatttttgagggaagtagaagatataaattgttagataaaatgtaagtttagtttaaaagggttatgtgttgttttttttagttttggggtattttttttttagaaaattggattgttttatagtgaaaattttgggggtggttagttttttgttttgttgttatttttattatttatagttttttaagaagtttttaggttgggtgttgaattttgattaggaattattgagaaattgaggtagttgggagaagttgtagttttaagtgttgaaaggaagatgggggataataaatttgggttgttaagtaaagggggtagaggtttggagaagtgggttttaggattagaggatagattgattttatattttatttttttagattttatattttattgttattattatttatgtgttttttttgttttttgtagtgggttttttagaggtattttttatggtttttttagattttaattttggtttgtttgttttttttttagaaaggtttttgtttgttttttttgtaggaaggtttgtatttttagaaagtttttgttttttgatttgaggatttaatttattaggggaattaaattttgtttttaggggagtggagagagaaattgggttttttttttgtagtttttgggatatagttgagttagttataggatttggggataattggggtggatttttttttttgggaggtggtggtattagtttagagtttgtatttttatttattggggaagtgtggggagaaggatgggttggagttgggttttggtttgaaggatagtagtttggagttaatggttgagtttttaaagtttttatattgtagaggaagtatagtggagattagttttagttaggatggttttgaagtttttagggatttgatgtagagttaaagaaatttatttgtgtttttttttttttttgggagtaggtagaagatttttgggaggagaggtgaatagtggatgttaatttttttgaaagtattgtgttttttagtattgtgggttgttatgggttttttgttgttgtgggattttggtttattttttgattgggttgttgtattttggattagattttgtgggtgatttatggaatttgtggagttgggatgtgaaaggttagaaggttttttgtttttattaagttttagggttttttgtggttgttgggagttgtagtttgaatgtttttattttggtgagaagtgtttatgttttttttattgagttttgtggtaatttttaaagtatttgtattgtttttttgttgtttgtagagggtgtagtaggttttgtattttttttgtattttattttttaggttttagatttgttttttttatttaaaaaatatttattattgagtttttatttgttatttagtattgatataggtatttaggaatataataatgaataagatagtagaaaaattttatatttttataaggtttatgtttttatgtattgaaagtaatgaataaataaattttattagagtgataagggttgtgaaggagattaaataagatggtgtgatataaagtatttgggagaaaatgttagggtgtgatattatggaaagtttttttaaaaaatgatattttaattgatgagaagaaaggatttagttgagagtaaatgtaaaagtttttttttttttattttttatatttgatataatgtaggatttttttaaaatgatttttattaattttgtttttatagttttggtttgtagaattttttattttaaaatgttagtatttatggtattaggttggtgagaattttgattttgtatttttttttttaattttattttttttgttttttttggtaggtggattatttgtttttatttgttatggtgattgtttagttttgtgttaggagttttgtaggggttgatgggattggggttttttttttttatgtgtttaagattggtgttaaaagttttgagttttttaaaagtttagagttattgtttagggagtaggtagttgttgggttttggggatattttgtgtttgggttgggagtgtgttttttatgatggtgatatgtttttttggattgggtaagtttttgattgaatttgatgagttttttttgagttatgggtttttggttttgtgtatttttagtttgggaaaattgttggggttgggggtggggtagtggggatttagtgagtttgggggtgagtgggatggaagtttggttagagggattattataggagttgtattgttgggagatttgggtgtagatgatggggatgttaggattatttgaatttaaagttgaatgtttaggtagaggagtggagttttggggaattttgagttggtttaaagtgtatttttttgtatatttatttggtgttgggtgtagggaatttttgaaataaaagatgtataaagtattgaggtttgagatttttggattttgaaatattgagaatttatagttgtatattttagagtttatggtattttagtgaaaattggggttttattttgaaatgattatttgggggtgatttggggagtttaagttgttaaggttttataatttttggatttttgttttttttggagtgatttttttaggtagtttttggttttgttagatggagaaaatttaattgaaggttgttagttgtggaagtgagaagtgttaaattaggggtttgtttgttaggttgaggaggattgttgtaatttgagaggtttggtagttttgttattgtttggttttatatttatatttttgttttttgtagtagtatttttggtttttttttgttggagtagtttattatttatttgatgagaggggaggagagagagagaaaatgttttttaggttggttttttttatttggtagagggaggttgttattttttgtttgtatttttttttttggattatttagttatggtttttgtaaaggtaggggtatttgttttgatgtaaattttaatttttttttttttttgaatggtgtgttttattttgtgggttgtttgtaatttaggtggatgttattatggtgtgagatagggagggaaagaagtgtgtagaaggtaagtttggaggtatttttaagaatgagtatattttatttttttggaggaaaaaaaaaaagaatgggtatgtttgagaattaaattttgaaagagtgtaatgatgggttgtttgataatttgttggaaaaataatttatttgttatttagttttgggttaggttattttagttttagatgtaggttgaatgttgtgaagtggaaggggtgggtttgtaggtgtttgtgtggttttttgtgtagttttttggtttgagttggttttttttggtaggaggtggaatttgaatttattttttttgttgttttattttttagtttgtggttgttttattttgtagtttttttttatgtatttgttgtgtattggttattttgtgttgtatttatgttattttttttttaaattgaggtggtatttatatatagtgttagtgtatatagtaagtgtataggaagatgagttttggtttttaattgttttgtgatgtttattaagttatagattttttttattgttttagaaatgttttattatgtttttttttagttgatttttgattttatttttattttgatttttataattattttgtttgttggagaattttatatagaatggaattaggttgggtgttgtggtttatgtttgtattttgggaggttgaggtgggtggattatttgaggataggagttttagattagtgtggttaatgtggtgaatttttgtttttattaaaaaatataaaaattagttgggtgt

SEQ ID NO: 783 - DNA, 4001 bp, Artificial Sequence
  chemically treated genomic DNA (Homo sapiens)
ttgatatggaatagagttaagatttttttttttttttttgatatggagttttattttgttttttaggttggagtgtagaggtgtaattttagtttattgtaagttttgttttttaggtttatgttatttttttgttttagttttttgagtagttgggattataggtatttgttattatatttggttaattttttgtatttttagtagagatagggttttattgtgttagttaggatggttttgattttttgattttgtgatttgtttgttttggttttttaaagtgttggaattataggtgtgagttattgtgattggttagatttaagatttgaatttaggtttttttggttttagaggtttttgttttttaattttttaggatggtatagtaatttgttttataagaggtgtttgttttaagtgtgtttagtatatggaagtaagtttagaaatgtaagtgtatatttgtaaagaggtgtgggagatgggggggagggaagagagaaagagatgttggtgttttttattttttagtttttgataggtgtttttgatttttttttgattagtatagttgtatttttggttggggtattttaattagaattgttaaatttagtatataaaaataaggaggtttagttaaatttgaattttagataaataatgaataatttgttagtataaatatgttttatgtaatattttgttgaaattaaaaaaaaaaaaaaaagttttttttttatttttatttttattattaggtttaaggaatagggttaggggttttaaatagaatgtggttgagaagtggaattaagtaggttaatagaaggtaaggggtaaagaagaaattttgaatgtattgggtgttgggtgtttttttaaataagtaagaagggtgtattttgaagaattgagatagaagtttttttgggttgggtgtagttgtttgtggttgtaattttagtattttgggaggttgaggtgggaggattatttgaggttgggagtttaagattagttttattaatgtggagaaattttgtttttattaaaaatataaaaaattagttggttatggtggtatatgtttgtaattttagttgtttgggaggttgaggtaggagaattatttgaattagggaggtagaggttgtggtgagtagagattgtgttattgttttttagtttgggtaataagagtaaaagtttgtttaaaaaaaaaaaaaagtttttttgatgtgattgtttttttttaaatttgtagatttttttaagattatgttttttagatattttaaagattttagaagatatgttttgggggttttggaagttataaggtaaatataatatatttttttttttgattattaattttattagaggatgtggtgggaaaattattatttgatattaaaataaataggtttgggatggagtaggatgtaagttttttaggaaagtttaagataaaatttgagatttaaaagggtgttaagagtggtagtttagggaatttattttggattttgggggagggggtagagttattagtttttgtatttagggattttttgaggaaaagtgtgagaatggttgtaggtaatttaggtgttttggtgttaggagggatgtatttaggtttgtgtgaagagagggagaaagtgaagttgggagttgttatttttagatttgttggaatgtagttggagggggtgagttgggagtgtgtttgtttttaattataggagaaggaggaggtggaggaggagggttgtttgaggaagtataagaatgaagttgtgaagttgagatttttttttattgggattggagaaattaggggagttttttgggtagttgtgtgtttttttttatggggttttttattgtgttgtgtgtttggtttttattttttgtagtattttgtgttttgtgtttttttagttgggtttagttggagttatggggttggagttgtagtgagtattatggagttggtggttttgtgttgttgggggtttttttttgtttttttgttttttggagttgtgagtatttaaggtgggtttggtgtggggaggggatggagtagtggtgggattttgttttgtggatgttttgttgaggttttgtggttggtggggttagaggggtttggatgagtttttttattttgaagttgtggatagttgagatgtttagggtagttgggttttggggtttttgggtgggagggggtagttatatggtagtggtttgagatggtttatttaagagattggtgttttttaggttttgaggggttttgggaatttgttaaagaagttttttgaaattgtttagaaagtttttttgtaaagggtgtattgtgtagagtgtgtgtgtgtgttttttttttttttgagtttttttaagtttttttaaagtttttttagttggtagtttttgtttttggattggtttgggttggattttttgggggggttttttgttttgttttttttttagtttttttttgtttttttttagatgattttggtttggttgtttttgtttttggtggggttgggtgtgtgtgtgtgtggtggagtggagggtggtatagtaatttgttttaattagagttggggaggaaagggtggtttggagggtggttttttgttggggtttgggttgggggtgggggagatgtttgttttgaatagatttttggggttagtttagggattgtgttttgtgatttttggagtgtgtggattatggaggggtgggggtgggttttttggggtgtaaagtgggagagtttttagagaaggaagttaagaaataaggttagatgggagtttagggagggttgtgttgttttgttgttttttttttggtgttgtgtgtggggaagggtgagtgggggtagtgtgtattttgatttatttgtttatttgtgtgtattaattataaaagttaatatatagtttgggttaggtatattttgttaggaattgtttgtggtgttttgtatgtatttttttttaattttagaatatttttatagtggaagttttgttagtattttggattgagtagtagtttagaggttgagtagtagttagtaagtggtggggttaagatgggattttaggtagtgtgatttttaattatgtatttgaaattgttatatggatgagtgtatttggagtaatgagggatattgttttttgagttattgggttgtaggggagataaaatgaaagtgttttgggagttgtgggtggtttttataggttagagggtttggggagggagtgggtgttattgtggttgtgtgttgtttgaggggttttttgtgagtgagtgtatggttgtgttatttttgtaggtttatgttagggtgttttttagttgtgtggtttttgtatttgtgtgtttgggttttgtgttgttaaatagtagtttttttgttgatttggggatataggttgaattttgttttttgtaggaatttttttaaggtgttgggttagatttgttataaatagagggaggtagttttttatggttatgtttttttgttgaggaagaaggttttttttttttagggagtatatttttgttttttttgttttttagataagtatttttattttttattttttgatgagaagggtgaggttatattgagttgttaggttgagttgttgtttttttttattttgggttgggagttgattagggaatggtagttgttgtagagttggatttgagggttgggttttttggatggggtttttttatgtttttattttttaatttgtattattgattgtgttgtgtaggagttagttaaaaagttattgtatagtttgggtaataaggtaaaattttgtataaaaaatataaaaattagttggatgtgattatatgtgtttgtagttttagttattttggaggttgaggtaggaggattatttgagtttaggaagttgaggttt

SEQ ID NO: 784 - DNA, 4001 bp, Artificial Sequence
  chemically treated genomic DNA (Homo sapiens)
aagttttaattttttgggtttaggtgatttttttgttttagtttttggagtagttgggattataggtatgtgtaattatatttaattaatttttgtattttttgtatagagttttgttttgttgtttaggttgtgtaatgattttttaattaatttttgtataatataattaatagtgtaggttgaggggtgaggatatgaggaggttttatttagagaatttagtttttaaatttagttttgtagtaattgttattttttgattaatttttagtttaaggtgaggaagggtagtagtttagtttgatagtttagtatggttttattttttttattagaagatgagaggtgaagatgtttgtttgggaaatagggagggtaaggatgtattttttggaagagaggaatttttttttttagtaagaaggtgtggttatagaaggttatttttttttgtttatggtagatttggtttagtattttaagggagtttttgtagaggatagagtttagtttgtgtttttaagttagtagagagattgttgtttggtaatataaagtttagatatataaatataaagattatataattgaggaatattttggtgtagatttgtagagataatatggttatgtatttatttatagagggttttttgggtaatatatagttatgatgatatttattttttttttagattttttgatttatggagattatttatgatttttagaatatttttattttgttttttttgtagtttagtgatttagggagtagtgttttttattgttttaggtgtatttatttatatagtgattttgaatgtatggttgggggttgtattgtttggggttttattttgattttattatttattagttgttatttaatttttggattgttatttagtttagaatgttggtagaatttttattataggggtgttttaggattaaaggagaatgtatgtaaaatattataaatagtttttggtagagtatatttggtttaggttatatgttagtttttatgattaatgtatataggtggatagatgggttaggatatatattgtttttatttatttttttttatgtatagtattaaggaaaaggtagtagaataatgtagttttttttaggtttttatttggttttattttttagtttttttttttgggaatttttttattttatattttaagaaatttatttttatttttttatggtttatgtgttttaaaagttatagagtatagtttttaagttggttttaagaatttgtttaaagtaaatgttttttttgtttttaatttagattttagtaagaggttattttttgggttatttttttttttttggttttggttgggataggttgttatgttattttttattttattatatatatatatatttgattttgttagaagtaggagtaattaaattaaaattgtttgaaggggagtggggaggggttggaggaggggtagggtagaggatttttttaaggaatttagtttaggttagtttggaggtggaggttgttaattggaaaggttttgagaaagtttgagggggtttaagaaggggggaaatgtgtgtgtgtgttttatgtaatatattttttgtgggaaaattttttgaataattttagagaatttttttgataagtttttggagttttttggagtttggaaagtgttagttttttggatgggttattttgagttgttgttgtgtaattgtttttttttgtttgagggttttagggtttggttgttttgagtgttttgattgtttataattttgggataggagagtttgtttgggtttttttggttttgttggttgtgggattttggtggggtatttatagggtagggttttgttgttgttttgttttttttttatattagatttattttgggtgtttgtggttttggggggtaagagggtgaggaggagtttttagtggtataaggttgttagttttatggtgtttattgtggttttggttttatggttttggttggatttggttgggagggtgtggggtgtggggtgttgtgaggggtgggggttgggtgtgtggtgtagtaaagggttttgtgggaaggggtgtgtggttgtttggggggtttttttggtttttttggttttaatggaggggaattttagttttataattttatttttatatttttttaagtagttttttttttttatttttttttttttttgtgattgggagtaagtgtgtttttagtttgttttttttaattgtattttaataagtttgggagtggtaatttttagttttattttttttttttttttgtgtaggtttgggtgtgttttttttagtgttgggatgtttgggttgtttgtagttgtttttatatttttttttggagaatttttaaatgtagaggttggtgattttgtttttttttttggagtttgggataaattttttaggttgttatttttaatatttttttaagttttaggttttattttaaatttttttggggagtttgtattttattttattttaagtttatttgttttaatattaaataatggtttttttattatattttttagtaaaattgatagttaaggagggggatgtgttgtgtttattttgtggtttttaggatttttggggtatattttttggaatttttgaagtatttgaaaagtatgattttaagagggtttataaatttgggaggagatagttatattgaaaggatttttttttttttttaaatgaatttttgtttttgttgtttaggttggagagtaatggtgtgatttttgtttattataatttttgtttttttggtttaagtgatttttttgttttagttttttgagtagttgggattataggtatgtgttattatgattagttaattttttgtatttttagtaaagatagggtttttttatgttggtgaggttggttttgaatttttaattttaggtgatttttttgttttagttttttaaagtgttggaattataattatgagtaattgtatttagtttaaaaagatttttattttaattttttaaaatgtattttttttgtttatttaaggaggtatttagtatttaatgtatttaaggttttttttttgttttttgttttttattagtttgtttaattttattttttaattatattttatttggagtttttgattttattttttaggtttagtggtaggggtggggatggaaggaagatttttttttttttttttaattttaataagatattgtatgggatatatttatattaataaattatttattgtttatttgaaatttaaatttaattgggtttttttatttttatgtgttaaatttggtagttttagttggaatgttttagttaagaatgtagttatattggttaagaagggattaaaggtatttattagggattggagaatgaaggatattagtatttttttttttttttttttttttttattttttatatttttttataggtatatatttgtatttttaaatttgtttttatgtgttgagtatatttaaagtaggtattttttgtgggataggttgttatgttattttagggagttgagaaataggggtttttgggattaagaggatttgggtttaaattttgaatttggttagttgtggtggtttatatttgtaattttagtattttgggaggttgaggtaggtagattatgaggttaggagattgagattattttggttaatatggtgaaattttgtttttgttaaaaatataaaaaattagttaggtgtggtggtgggtgtttgtagttttagttatttaggaggttgaggtaggagaatggtgtgaatttgggaggtagagtttgtagtgagttgagattgtgtttttgtattttagtttgggagatagagtgagattttgtgttaaaaaaaaaaaaaaaaattttgattttattttatattag

SEQ ID NO: 785 - DNA, 6001 bp, Artificial Sequence
  chemically treated genomic DNA (Homo sapiens)
aaatttataggtgttggtgttatagaggaagagattattttttttgttattataattttaaatttaaagagaatattttagttattaaaatattttatagatttttaataaaaaaaagtattattttgaagttttaaaatatttgttttaaattttaaatttaataattatagttgtattgtaaggttattgtttattgataattttaaaatttagttaagtgattaatatttgtttttattttttataatttttttttagttaatttttttttagtatttttttttgatagtgttattttttaaagtttgtgttaatattgatagtggtgaatgaaagtttaatatttgttttttgttttttttttatttttattttttgtttattaggtggataatatttatgattataaaattttatattttggaaaagagttagtgatgatttttgaatatttttttattatttttttatttttaattgtttttttgttttaatgattgaaataattttttatttgaaatgtatttagataaagaggaaataaagttttaataataaagataaataggtatagtgttttttgtgatggtttgtttggtttaaatgaagattgattatttttaagttaataggggtggaagtggggtgttaagtttttgataatttatttgtaaaattagtttattttttttagtttatgtagttttttttaaaatatttggtaaatatgtaattttttgattgtaaatgttaattttatatttaagttagttattttttaaaataatgtaagggttaggaatgaagtaaattagtttgtgttggattataaagttattaatatttttaaaaattgtttttgtaggtttataattattattataataaagtatttaaaaagtgattaggtaatagtaaagtgaaatttatttttttaaaaataatatatatgtatgtatgaattaagaagttatagaaatatgttgagttttattaaaatgttaaatttagaaattgttaaaaaagagaataatttattgatttaaatttaatagggttgtatattttaatttgtttttgtaaaggataaattagaatgatgtataataattttttttttggtatttatattagtaataattaggaattatataggtttttattttgagttatagttggttatttttttttttttaaagttatatatattttagtttatatatatttttgaaagatattttatttagagttagatttaattatagtaaaattatatttatagaagatgaaaaattatatatatatttgttaaaattagaatagattatatttaggggataatatttaggtatgttaatggagtttaaaatgttaaggaaattatattataattttgtttagtatattataggttgttaaattgaaatgttatgttagttaggagtgtagtaatttttattttttggttttatttaattaggaagttttagtagagtgaagtttgttaagtgtttgttgttagaatttgaaggaatttgagtgagtaagaagagtgtttgatttattttatagaagtttgtttagaaatggaggagttagtgtttattgaagttggttttgtttttggtttgtttatatggagtttgattagttttagttatgtttattttggtttgggagatttgtaaagtgtttttttttttaatttttttgtattattttgaagtttagggaagtaaagagaggggtatatttggattgtaaaattaatgttttttgttgtttaggagagaagggaatgagagagagagagagatagatagatagagagagagagagagagagagagagagagagagagagagagagagaaattttattgaaatttagtttttttagaatttgtgtgatttggtttttaatgggagattagtgtgattttatggtatttttgttaggaattagtgatttttttgtagttattatttgatttattgtttttttgtttatttttttttataaagttattttttttttattttagtaagatttttttttttaatgatgataaagtttttgttttagtgttttttttaggattggtgtttttttaaaatagtgaatttagaaaattattttgtttaatattttttaaaatttttgtagttttaatgtaagtgtaagtatgtaaaggttttttgttatatttgtattttttgtttattttagaattattttttatttttgggtttgtaatagttttttttgtttttttggatagaggtgggtggtattaggggtttagggtagtaggaggtgaggggttgaggaggtgtgttagggtaggttggtttgtgttggatatgtgtgtttttttgtggagttaaagggttggggatgggggttttggatttattagagtaattttagttggtgggtgtttggtagttatttaaggaggtagggaaagtagtgagttttattgggtgggttatgatgagtagtatgatgggtagtagtagtagttagtaaaagtttttgtaaagtgtttagttgttgtattgttgtggggatttttatagtattatgattagtttgtgtaattttgtagtagtaaatggtttttgaggaatataggattgtgggggttgggtagtgggttattgagtattttgtggatggtggtagtagaggtggtggtggtggtagtggtatttggtggggaagtagtagttaaatttgtgtatgattttgagagttttagtaatatttagggattgggtttagttttggagtgagagggttgtttgttgagaagttgtgttggagatgtgggaagttgttgttataaggagggagttttgggaagttggaggataggaggagatgggagtttaggggtagatgagtggagtttgaggaggtagggtggagggagagttaaggtgttttgtagtttggtagttgttttttgagttttgttgtttgtatttttttggtgtttgggaagtagtaggtttttagtttgtttggggttatgtgggaagaggtagttgggttttgattggtggagtaggatgtaggttttgggagggaggggttgatgaggaggtgtaaggatgtaaggaggaggtggttgtggaagttatagatgggtttgtttgttaggtgttggtttgagtggggttaggtggggatggtttaaatgagaagtttgggttttagggtgggttatttgtatatttatatattatttgttttattttttgttttaggatgttttttattgaaggtggggtttggattagtgttttttttttgtgtgtgattttgggttgtgagtgtgggttgtggttgggtggtgtttttttgagttggagatggtgggggtggaggtgttagaggagtagtagtagtagggtagagaggggtgagttggtgtgggagagggtgttttgttggtgattggtgttttagtgtgtgggagtgtgttgtttaggttgtagggggatgtaggttgggaatgttgtggtggagaggttagggatgtttttttagggatttataggaaagagggtgagaggtgatggtgttagaattgtttttgttgatttggaagtaatagtagtattttttataagagtgtgtaattttaaggttgtttgttgaggtagtttagttattttggtaggtgttttttttttttttttttttttttttttttttttttaggttttttgtagttttgatttagtttaagtgtttgtaggtttgaatttttttttttattatttgtttttttttagtttgtagtttattagtgtgtttatttgggaggtgtggttagatgtgtttggaaggttagattggttgggataagtggtttgagagaaagagaaaggtttttttgtatatgttgtgggtgggttgttgggagtattggttgggtagtggtgtttgggaaggggagagtgggttttatttgttggtttaggtagtgattttgtgttttttatttgggtttttgttggatggttggtgatttggggtgatgagagaaggtttaatttggtaggagtttttggttttgtgtgttttttttattttttttagtgggaagggtaaatggtatagtgggatttgttttttgtttgttgtattttttaggtagttagatatattttttagtttaatggaattttagttgttagtaatgggattaagagtttttggggataagggtggagaggaatattttttttttatgattggggttattattgtagttttagtgttttggatgttttatagggaagagttttttttttggtgtgtgattatttagtgatttttgtttttgtttttgtttattttttttttgttttttttttttatttttttttgttatttttttttttttttttttttttgtttttaaaagtttttggattttttttttttttatttaaattttttttttgtgtttttttttttgtgttttttgaatttaggagagtatttgataatatttaataggtaattagtgtttatttttaattatttaaaagaggtatttatatattttgaaaatgggattatttattttttgtagatattagtagaaaaataaattgtatttgagtaatttttttaagtattttaatttttaatttttttttatttttttgttttttaattttttttttgagagatgtgattgtgtagtattttagtgttttaatgaaattttttttttttttttgtgtgaaatttatttttttattttatatttttgtttttgtttgagattgtttttttttttttttatttttaaagatttttgaattttagtgttttttatttttggtaattaagtagtagattttagtattttagttggtggtattttgttttttattgatgaagattttattaaaatagattaattagattagatgttggaggtattagaaaattggtttttagatagagtagttaaattttttaaggaaatagaatatttattagatagagttgttaattaatattgtaaaataaggaattagaaattttttttgttataggtttttagtagagaaggtaatataaatatagattaagatttaataattttatagtagagaatgagaatatgttattttttatagtaaggttggtgtggtaattaattaggtttatgaaaataagttatgtttgaaattaaaggtaaagtttttaaaagtgtttatgtagtaattatgataatgaaataggatttgttaggattttagagtttggttatgtaagtagaattttagagaattttttagtagaggaaaattgtttttgaattttttgttaagtaaatttttggtatattttttaataatatatgttttttttaagatgttttgttaaaagtaagttaaaattttaaaggagttaattattggttgtaattggttaataaatgtggttgtttttatagaggttttttaaattattaaatagtttgaagtaaagtttttttaatgggaatgttgtaattttgttgtatttattttgtatttagtgttatagtgttattaagaaataaattttgaaattggtaagtattattaagtggtagaagaatattatttattgagtagagaattgtattattgaatatgtaaataaaaatatatatattatttagatttgttattaggtattaaagaagtagataagattgtattagtaattggattagtgttttaatttttttttagtaaggtaaaattagtttatttattagaattaaatttaagtttatgaattgtattttgtattgtgtattatatgattgttagtaatatgatataattatattatgtatttgtaaaatttttattttaaaatattatattatatttatttttaatttttttgagttagaatattttatttgtggtatatatattttagaattgatgtagaggagtagagtttagttgtt

SEQ ID NO: 786 - DNA, 6001 bp, Artificial Sequence
  chemically treated genomic DNA (Homo sapiens)
aataattggattttgtttttttgtattaattttagagtgtatatgttataaataaagtgttttagtttaagaagattgaaagtaaatatggtatagtattttaaaataagaattttgtaaatatatggtatgattgtgttatattattagtaattatatgatatgtaatgtaaagtatagtttatagatttaaatttaattttaataagtaaattgattttgttttgttggggaaaagttaaagtattaatttaattgttaatgtagttttgtttatttttttggtatttagtgataagtttaaataatgtatatatttttatttatatatttagtaatataattttttgtttaatgagtgatgtttttttgttatttggtggtgtttgttagttttagaatttgttttttggtggtattataatattaagtatagagtaagtgtaataaaattgtagtatttttattgaaaaggttttgttttaaattgtttaataatttaaaggatttttgtggaagtaattgtatttgttaattagttataattagtaattaatttttttggagttttaatttatttttggtaaaatgttttaggaagagtatatattattagaaagtatgttaaaaatttatttagtagaaaatttaaaaatagtttttttttgttaagaggttttttaaaattttatttatatagttaaattttgaaattttagtaggttttgttttattattataattattgtataaatatttttaaggattttgtttttagttttaagtatgatttatttttataagtttgattagttattatattagttttgttatggaaaatgatatgtttttattttttgttgtagagttgttaaattttgatttatatttatgttgttttttttgttgaaagtttgtagtgaaagaaatttttaattttttgttttgtaatattagttggtagttttatttaatgggtattttgtttttttaaagaatttagttgttttgtttagaagttgattttttgatgtttttaatgtttggtttaattgatttgttttaatggagtttttgttggtgaggagtgagatgttattgattagaatgttgggatttgttgtttaattgttaggagtgagagatattgagatttagaaatttttggaggtgggaggggagagggatagttttggatggaggtggagatgtaagataaagggatggattttatataggaaaaaaaaaaagattttgttgaggtattgaggtgttgtatgattatattttttaaaggagaagttaaaaagtaaggaagtgggaggaggttggaggttaaagtatttaaaaggattatttgggtataatttgtttttttgttggtgtttgtaaaggatagatagttttgtttttaaagtatatgaatgttttttttaagtgattgggaatggatattaattgtttgttaaatgttattaaatgtttttttaaatttaggggatatagaaagaggggtataaaaggagaatttaaatagaaaaagggaggatttggaggtttttgaaagtggggggagaagaaggaggagggataatagagaggaatagagaaggagagtggagagaagataaataaaaataaaaataggaattattgaataattatatattaaaaagaaagtttttttttatggggtatttaaaatattgagattgtaatagtgattttggttatggaagaaagatgtttttttttatttttgtttttgaaagtttttggttttgttattggtgattaaaattttattaggttaaagagtgtgtttaattgtttgaagaatgtagtagatggaaggtgggttttgttatgttgtttgttttttttgttggagagaatgaaagaaatgtgtagagttagagatttttgttgagttagatttttttttgttgttttaggttattggttatttggtaaagatttgagtaaggaatgtagggttattgtttgggttaataaatggagtttgtttttttttttttggatgttgttgtttggttgatgtttttggtaatttatttgtggtgtatgtagaggagttttttttttttttttagattatttgttttgattaatttgattttttaaatatatttgattgtattttttaggtggatatattaataggttatgggttggagaggagtgggtgatgaggagagggatttaaatttgtgaatgtttgggttgggttggagttgtggggggtttgggaggagagaggggagaagagagaaggaaggagagtgtttgttgggatggttgagttgttttggtgagtagttttggggttgtatgtttttgtgggagatgttgttgttgtttttaggttggtaagagtggttttaatattattgttttttatttttttttttgtaaatttttagagaaatgtttttggtttttttgttgtgatatttttagtttgtatttttttatagtttaggtggtgtgtttttgtatgttggagtgttggttgttagtaggatgtttttttttgtgttgatttgtttttttttgttttgttgttgttgtttttttgatatttttgtttttattatttttagtttggagagatgttatttagttgtggtttgtatttgtggtttggggttatgtgtggaagaggggtgttagtttggattttgtttttggtagggggtgttttggagtggagagtgaggtgaatggtatatgagtgtgtgggtagtttattttgaagtttgagttttttatttgagttatttttgtttagttttatttgggttagtgtttggtgagtgagtttatttgtggtttttgtggttgttttttttttgtatttttgtatttttttgttgattttttttttttgggatttgtattttgttttattaattagagtttgattgtttttttttatgtgattttgggtgggttgaggatttgttgttttttaaatgttagagggatgtgggtggtagagtttgagaggtggttgttgggttgtggggtgttttgattttttttttattttgtttttttgggttttatttgtttgtttttggatttttgtttttttttgttttttggttttttagagttttttttttatggtagtagttttttgtgtttttggtgtagttttttagtggatgatttttttgttttggggttgagtttagtttttggatgttgttgaaatttttgagattatgtgtgggtttggttgttgtttttttgttgggtgttattgttattgttgttgtttttgttgttgttgtttgtgggatgtttagtagtttgttgtttggtttttgtgattttgtgttttttggaagttgtttgttgttgtagagttgtatgaattagttatggtgttgtgggagtttttgtggtagtgtagtagttggatattttgtgagggtttttgttggttgttgttgttgtttgttatgttatttattgtagtttgtttggtgaagtttgttgttttttttatttttttaagtgattgttaaatgtttattggttggaattgttttggtaagtttagaatttttgtttttgattttttaattttgtagaagaatatgtgtatttagtatagattagtttattttagtgtgtttttttagttttttattttttattgttttagatttttaatattatttatttttatttagagaaataaggggaattgttgtaggtttgggggtgaggggtggttttgggatgggtagaaagtgtaggtgtagtaggaaatttttgtatgtttgtgtttatattggagttgtgaggattttgagaaatattaaatgggatggttttttgggtttattgttttgaaagagtattaattttaggggaaatattgaaatagaagttttgttattattaaagaaaaaagttttattaggatgaggaagaaataattttatgagaaagaatgagtgagaaagtaataaattaaatggtgattgtaggggaattgttgatttttggtaaaggtgttatgaggttgtattggttttttgttgaagattaggttatatagattttagaggagttgggttttaatagaatttttttttttttttttttttttttttttttttttttttttttttttttatttatttattttttttttttttttattttttttttttttaggtggtaaaagatattggttttgtagtttagatatgtttttttttttgtttttttaagttttaaggtagtataggggagttgagaaaaagaatattttgtgggttttttaggttggagtgggtatgattgaggttggttaggttttatgtaggtgagttgagggtggaattgattttagtgggtgttgatttttttatttttggataggtttttgtggagtgggttaggtattttttttgtttgtttgggtttttttagattttgatggtgaatgtttggtaggttttgttttgttgaagttttttaattaaatagggttagaggatgggagttgttgtatttttagttggtatagtattttggtttgatagtttgtagtatattgggtagaattgtggtgtaatttttttggtattttaaattttgttaatatgtttgggtattgttttttaggtgtggtttgttttagttttagtaagtgtgtatgtaattttttattttttgtgaatataattttgttgtagttaaatttggttttgaataaagtgttttttaaagatgtatataagttgaagtgtatgtaattttagagaggagggaatgattaattgtaatttagggtgaaagtttgtatagtttttagttattattgatgtaaatgttaaaaggaaaattattatgtattattttaatttattttttataaagataagttgagatatgtaattttattagatttgggttaatagattgtttttttttttggtagtttttaaatttggtattttaataaaatttaatatgtttttataattttttgatttatgtgtatatgtgtgttgtttttgaaagaataagttttattttgttattgtttaattattttttagatgttttattatggtaataattatgagtttgtaaaaataatttttggaaatgttgatggttttgtagtttaatatagattggtttgttttatttttagtttttgtattgttttaggaaataattaatttaaatgtgaagttgatatttgtaattaagaaattatatatttattagatattttaaaggggattgtataaattaaagagaataaattggttttgtagataggttgttaagaatttggtattttgtttttatttttgttaatttagaggtgattaatttttatttgagttaaatagattattatagaaaatattgtgtttgtttatttttattattgaggttttgttttttttttgtttggatatattttaaataaggggttgttttagttgttgaagtaaaagaataattaaagatggggaaatggtaaaagggtatttagagattattattagtttttttttaaaatgtggagttttgtggttataaatattgtttatttaatgagtaaaaaataaaaataaaaaaaaaataggaagtaaatgttaagtttttatttattattgttagtattaatgtaagttttaaaaaatagtattattagaaaaggatattaaaggagaattgattagaaaagaattgtggaaaatggaaatgaatattgattatttaattagattttgaggttattagtagatagtgattttgtagtatagttatagttgttggatttaaaatttaggataagtattttaaagttttaaagtagtgtttttttttgttaaaaatttgtaagatgttttaatgattggagtgttttttttgaatttgaggttatgatgatagagaaaatgatttttttttttgtgatattaatatttgtaaattt

SEQ ID NO: 787 - DNA, 7001 bp, Artificial Sequence
  chemically treated genomic DNA (Homo sapiens)
aatgtaatggaaaaagagagattgtaaagttagaaggtttaggaattgttttttgattaggtgtggaaggtaagggaaaattagtttttgaagaagatagtgagattttaatttgggtggttggagagatagtgatgttgggtatagatatggggaagttgagaggaatattatgtttgagaatggtgatttatatttgaataagtttgtaatgtttagtagattgttggaaaagtggggttggagatatatttaatggaggagttagattaatttttatttttttttatttgagagagttagtaagttatggttggaatgtgtgtgtttagtaggagagggtagggagggaagttaagagagttgggagtttgagtgaagtttttgttaaaggtagaagaggaaagttggtgtagtatagtatatttttttatttatgtttattaagtttagggataaggtttattaagatgagtttggaagagaatgttggagagaaagtggttaagaaaattgtttttattgaattttttgggttaattttgattgtaagtttttgaataattaaagtttgtgaggagatagttaatttttttattttttttatgttaatagtgaataattgtagatttttttttttttttttttttttttttttgttttttttttttttttttttgaatatttttgtttttttttgggattggtttagagtatgggtggttattgttgatttataggaggtattattgttattaataaagggtaatagtttttttttttaatatttatttatatttagtatttatttttaatattgattatggagagagtttttttgtgtttaaatattgtaatattgggggttttttaaagtataaaaatatatatttgtatgatggtattattaatatttttatggttttttattttttttttgtattggttttaagagttatttataaattttttagtaattgtatagtgttttagggttagagattggttatttttggtattgtgattagagttatttaatatttaaggtggtgattaatgtttggtaataaagtttttattgggtgttatgtgttttgggattttgagtgtgggtattttaggagtattttagtattgtgtgttagtattatggttgagagaatagttgagaaagtggttaagaggtggatttatgtgaatgttattgggaaatgagagattttgtttttaattatggttagtgtaatttgaaagtttaaaattagtttaaaataaaggtatttatttttattttatgtttatattttaggtttttaataatatgtattttttatatgtttatagaaagtagttaattgagttatttatggaaaggtttgtgggtttggttaatgaagtggaggagtattatattttagttggaaatatatttttagaatgttaaaatatttattttaaagtttggttttttggtgtaattggaggtatggtaatgtttttgtttagagattgggggttagggttagtaaggtatttgatttatatgtattttagaaggtttttattgttaaattatatttttttggaaaaattatttatgttttattttgtaaatttgatatttatatatttttgattggtattttattttagttgtaagattatgatttatagtaagtttgtttttttttttgtttggggtggtagtagaaagtatagggtattttttagtttttaagggtaggggtaaaggggttggggttttttttttttagtatagttttttttggttgtgttatattgttttttgtgagtagatagtaagtttttttttattttttattgttatttatttagtgttgtgtagtagtttagttgtgtgtttgttgggaggggttgttaagtgttttgtttattggttgttttttgaatttttgttattttatgtataaatatatttatatattttttttgtttagtttatatattgagttatttgtatatgtgagtatatttttttttttttttttatttttttggtttttgatttttataagtttatggaatatttttggaaagatgtttttgatttagtagggtaggtttgttttgatttttttttttgtagttttagtattttgagaaagtaatttatttttttggttagtgtttgtattttagtagggagatgaggattgttgttttttatgggggtatgtgtgtgtttttttttttttttaggatttgtaggattttttgtgttatttgtatataatttggtaggtttatattttttaagagttttatgaagtgttttttgtatgtgttttaaaaaggtatttgaaaattgaaagtgtgatttatggaaattaaattatttgtaaaaaattgttttggaaagtaatgattgttggttataaagggaaatatttgtgatgtatttaatgtgtttttaattttttatttgttgataatttatagttattaatgttaaatttgattttggttttagttatatttgtatattgtttaataatggtttatttttgtaagaattagataaaatgtatatttgatataaaatagttaaaaatgtaatttttagtaatagtaagtttggtatttagatagattatgaatattttgttagatattttgttgggtgtttgggatagtaattaaaataaagtattgatagttgtattagagtttattaggttgtagtaaaggaagtttatttaaaagtataaattatttaagattatagatgtatgatatattttatttattttttgtttttttaatatgtatatatatatatatatatatatatatatatatatatgtgtgtgtgtatgtgtgtgtgtatgtttaatttttaatttagttaaaaatttttttttatttgttttttatttggatatttgattttgtatattttagtttaagtgaattgagaagattgagttgtaggattaaaggatagatatgtagaaatgtattttaaaaatttgttagttggattagattgataatgtaatataattgttaaagttttggtttgtgatttgaggttatgtttggtatgaaaaggttatattttatatttagttttttgaagttttggttgtataattaatttgtggaaggtatgaatatttatgtgtgttttaattaaaggtttttttgaattattttttatatgagaatttttaatgggattaagtatagtattgtggtttaatataaatatataagttaggttgagagaattttagaaggttgtggaagggtttatttattttgggagtattttgtagaggaagaaattgaggttttggtaggttgtatttttttgatggtaaaatgtagttttttttatatgtatattttgaatttttgtttttttttttttagatgttttttgttagtttttttagttgttaaatatagttgtttgtggttggttgtgtatgtaattgtatattttattttatttgttttattttggttatagtgtagttttttttagggttattttatgtatatattatgtatttttagttaatgaggagggggaattaaatagaaagagagataaatagagatatattggagtttggtatggggtatataaggtagtatattagagaaagttggtttttggatttgttttttgtgtttattttaagtttagttttttttgggttatttttagtagatttttgtgtgtttttgttttttggttgtgaaatttagtttttatttagtagtgatgataagtaaagtaaagtttagggaagttgttttttgggattgttttaaattgagttgtgtttggagtgatgtttaagttaatgttagggtaaggtaatagtttttggttgttttttagtatttttgtaatgtatatgagtttgggagattagtatttaaagttggaggtttgggagtttaggagttggtggagggtgtttgttttgggattgtatttgtttttgttgggttgtttggttttattggatttgtaggtttttggggtagggttggggttagagtttgtgtgttggtgggatatgtgttgtgttgtttttaattttgggttgtgttttttttttaggtggtttgttggtttttgagttttttgttttgtggggatatggtttgtattttgtttgtggttatggattatgattatgattttttatattaaagtatttgggatggttttattgtattagatttaagggaatgagttggagtttttgaattgtttgtagtttaagatttttttggagtggtttttgggtgaggtgtatttggatagtagtaagtttgttgtgtataattattttgagggtgttgtttatgagtttaatgttgtggttgttgttaatgtgtaggtttatggttagattggttttttttatggttttgggtttgaggttgtggtgtttggttttaatggtttggggggtttttttttatttaatagtgtgtttttgagtttgttgatgttattgtatttgttgttgtagttgttgttttttttgtagttttatggttagtaggtgttttattatttggagaatgagtttagtggttatatggtgtgtgaggttggtttgttggtattttataggtatttgtgtttgtgttgtttgttggggtggttgttgtgtttggtaggagggagggagggagggagggagaagggagagtttagggagttgtgggagttgtgggatgtgtgatttgagggtgtgtgtagggagtttggggtgtgtggtttagtttgggggttttgtgtgtagtttgtgttgtgtttagagttaagtttttttgttgggtagttgaaaaaaatgtattttttatttatttattgtttgtgtgagaggtagatttgaaagtttgggttttttaataaaatatatgttggaaaattagataaagtagtagttatttgtgggggaaaatatttttaggtaaataaatatggggtgttttgagttatttgggaaggttttgtttttggtatttaaagttgggggtgtttggagttagtagagtttagtagagttttatttatttttttaatgtttttgtttaatgtgttttttaaatttttttttatttagattatttgattggaaatatgttagttatgatgatgattttttgggaagtgatttttgttatttgttttttttttttttttattttatgttttggggttttagagagtgattgggagttgaatgggtttgattttggagttagttggttgagtttgtgttggagtggattgttggtatgtgatttttgatagttggaaatttgtaggtgttttgtgagtttaaaataagttatatggaagtataagtgtttaaaaataattttttgttagtttagtgataagtttgttttatttggggagaatgttttggagtggtgtgtgggttagttagggtttgtgttttgtagttattgtggaaggagtgtggttggtttaggatataggagattattttgtgattttaatggtgaaggttgtgtgtttttattttaatttttttttttataagaattgttttttttttttttttttttttttttatttttttttgtttagtttttttttttgttttttgttttttgtttttttgatgggtttgtagagggattaggtgggtgtttttggtgaatatttttttaggtggttataggataggtgtattttggattgggtttggaagttttagggtgttatatggttgggttttgaattaggtattttttaattgtatattggtatttggattggtgtttttatatttttttgttttgtaagttgtggattagtttttgtttagtattttgtttttagggatatttatagtagaaggaaggggattaaagtgtagtttggttttagaggatattgaagggtagattttgggggtatttagtgtgtatttttagttgttttggagaaatttagagtattttatagttatgtagatttaagttgtttttatttaaaagataaataatgaataaaatttttaaaggttggtatattttaaattaattttatttgttttaatttagggttaaaatagagaaaaaggattttttttgtttatttttttttttttaaatggaagaataaagtatagtgattaagtttaattttatataatatttaaaattgtttgatgtgaaggaaggtattggtatgatgtgaattttataattttatgatggattttagaaattatttttttttttatttaatttttagtttttttattgtaaattaatgttgttgaattttaatgggtattaatgagattgttttttggtagattatttattgttttgttaataattataaagtgaatttggttaaatatagaggggattgtattttatttaaaattgtttattattttagtgataagtggtattagtgtaatatgttttattttatattttttgtattatatgatatttaaatatttttagaataataaaaaaagagataaggaatttaaaaattaaaaaaaaaatttgtataaatgggattttgtgtggaaatttagttttagaatgattttttttgtgttttattttttggattatttttttttttttgttagaattttgtttgttattatttagtaaggaaaagaagtatttatgtaagttttttatatggatagatattatttagtatttttttttttttagtttttttgtttaaatgattttgggtataaaggaaaggattgattgggtttttttaggaaattttaagttttttaagtagtttttaaaagttttggggttgaaagtagtgtttttaaattgtttgttatgatttagagggttatgaatttagtttagtgagtttagaatattttttaaaaggattaaaatggaaaggaatataatagaaaatattagagtgtatggtattttgtaaggataagttttgt

SEQ ID NO: 788 - DNA, 7001 bp, Artificial Sequence
  chemically treated genomic DNA (Homo sapiens)
ataaaatttatttttatgaaatattatgtattttgatattttttattatatttttttttattttagtttttttaaaaaatattttagatttattaaattgagtttatgattttttgggttatgataagtagtttgaaaatattgtttttagttttaaaatttttgagaattatttaagaaatttaaagttttttaaaagagtttaattaatttttttttttatatttagagttatttaagtagaaaaattgagaggggaaaaatattaaataatatttgtttatatgaagaatttgtatagatgttttttttttttgttggataataataggtagaattttaataaaagaggaaagataatttgggaaataaaatataggaaaaattattttaaaattgaatttttatatagagttttatttgtgtaagttttttttttaatttttaagttttttgtttttttttttattattttaagagtgtttgaatattatgtaatgtagaaagtgtaagatagggtatattatattgatattatttattattgggatgatgaataattttgaataagatgtgattttttttgtatttgattaggtttattttgtaattattagtaaggtagtaaataatttattaaggagtagttttattagtgtttattgaaatttagtagtattaatttgtaataaaagaattgaaaattaaatagggaagaaaatggtttttggagtttattataaggttatggaatttatattatattagtgtttttttttatattaagtagttttaaatgttgtgtggaattagatttaattgttgtattttgtttttttatttaaaaaaaaaaaggtgggtagaagaaattttttttttttgttttaattttaaattaaaataagtaaaattaatttgaaatatgttaatttttaaaagttttgtttattgtttgttttttgagtaaagatagtttggatttgtgtggttgtgggatgttttaaatttttttaaggtggttgaagatgtatattgaatatttttagaatttgttttttagtattttttggggttaaattgtattttagtttttttttttttgttataaatatttttggaaatagaatattgaataaaaattggtttatggtttataaggtagaaagatatagggatattagtttggatattagtgtatagttgggaaatgtttaatttaggatttagttatgtggtgttttgaagtttttaaatttagtttggggtatatttgttttgtggttatttaggaaggtgtttattagaagtgtttatttaatttttttgtaggtttattaggaaaataaaaaataaaaaataaaaggagaaattgggtaagagaaaatgggagggagaggagagggagaaagaataatttttgtagggaaaaaaattaaaatgaggatatataatttttgttattgaagttataaagtggttttttgtgttttggattggttgtgttttttttatagtggttgtgaggtgtagattttggttgatttgtatgttattttggggtattttttttgggtgggataggtttgttattgggttggtaggagattatttttaagtatttgtgtttttatatggtttgttttaaatttgtgggatatttataaatttttggttgttagaagttatatgttagtaatttgttttagtgtggatttagttagttaattttgaaattagatttatttaatttttaattgttttttaaagttttaggatgtggggtggggaggaggggaaagtgggtgataggaattgttttttagaaagttattattatagttgatatatttttaattaaatagtttagatgaaaggaaatttggggagtatattaaataaaaatattaaaaggataaataaaattttgttgagttttgttaattttaaatatttttaattttaaatgttaagagtgagatttttttaagtgatttaaagtgttttgtgtttatttgtttggaggtgtttttttttataaataattgttgttttgtttggttttttaatgtgtgttttgttaggaagtttgggtttttgggtttgttttttgtatggatggtaagtgggtggagagtatgttttttttagttgtttggtgagagaatttgattttgaatgtagtgtgggttgtatgtagaatttttgggttgggttgtgtgttttgggttttttgtgtgtatttttgggttgtgtgttttgtggtttttgtagttttttaggttttttttttttttttttttttttttttttttttgttgggtgtggtggttattttgatgggtggtgtgggtgtgggtatttgtagaatgttggtgggttggttttgtgtattgtgtagttgttgggtttgttttttaggtagtagggtatttgttggttgtggggttgtaggaaaggtgatagttgtggtggtgggtgtagtagtattagtgggtttggagatatgttgttgagtggggggaaattttttaggttgttggagttgaatgttgtagttttagatttggggttgtaggggaggttggtttgattgtagatttgtgtgttggtggtggttgtggtgttgaatttgtaggtggtgtttttggggtagttgtatatggtgggtttgttgttgtttaggtatattttgtttaggggttgttttagggggattttgagttgtggatggtttaggggttttagtttgtttttttggatttgatgtagtagggttattttagatgttttggtgtggagggttatggttatggtttgtggttgtgggtagggtgtagattgtgtttttgtagggtagaaggtttagaaattggtgggttatttggaaaaagagtatagtttgaggttagaggtgatgtagtgtatgttttgttgatatgtgagttttggttttggttttgttttgggagtttgtgggtttggtgaagttgggtgatttgatgggagtaagtgtagttttaggatgaatgttttttgttagtttttgggtttttgggtttttaattttaagtattggttttttgagtttatatgtattataaaggtgttggaggatggttagggattgttgttttgttttgatattggtttaaatattattttaggtataatttgatttggagtgattttaaagagtagtttttttgaattttattttatttgttgttgttgttggatagaggttgagttttatggttagggggtgggggtgtatgaggatttgttaaaggtggtttagggaagattgggtttaaaataaatgtgaaagatggatttaggggttggttttttttaatgtgttgttttatgtgttttgtgttagattttgatatatttttgtttgtttttttttttgtttgattttttttttttgttggttagaaatatgtagtgtgtatataggatgattttggggaggattatattgtaattgagatagggtagatagaatggggtgtgtggttgtatatgtagttagttatagatagttatatttagtagttgggggaattgatagggggtatttgaggggaagggggtggagatttagggtatatatataggaagagttgtattttgttattaggagaatgtaatttgttaggattttagtttttttttttgtaaaatgtttttaaagtagatagatttttttataattttttgagatttttttagtttgatttgtgtgtttatgttggattatagtattgtatttggttttattaggaatttttatgtgaaggatgatttagaaaaatttttggttagggtgtatatgggtgtttatgttttttataggttggttatgtaattaaaattttagaaaattgaatataaaatgtgatttttttatattaaatataattttaggttatgaattaaagttttggtaattatgttatattgttggtttggtttagttaatagatttttaaaatgtatttttgtatgtttattttttagttttataatttgatttttttggtttatttgggttaggatatgtagaattaaatatttagatgaaaaataaatagaaaaaagtttttaattgaattaaaagttaaatatgtatatgtatatatatatatatatatatgtgtatatatatatatatatatatatatatatatattaaggagataaaaaataggtgaagtatattatgtgtttataattttggatagtttatatttttgaataaattttttttgttgtagtttaatagattttgatataattattaatattttgttttaattgttattttaaatatttaatagagtatttgatgaagtgtttatggtttatttaaatgttaagtttattgttattaagagttatatttttgattattttatattaagtatatattttatttaatttttataaaaatagattattgttggataatatgtaaatgtagttgaagttaaaattgagtttagtattaatgattatagattgttagtaaataaagggttaaaaatatattaggtgtattgtagatatttttttttatggttagtaattattattttttaaagtaattttttatagatgatttaatttttataaattatatttttaatttttaaatgtttttttaaaatatatgtaaaaagtattttatagggtttttaaaaaatgtgaatttgttaaattatatgtaaatggtataaagaattttataagttttgaaagaaaaaggagatatatatatatttttatggagaatagtaatttttatttttttgttaggatatagatattagttagaaaggtaagttgtttttttaaaatgttaaagttatagagagagaaattaaaataagtttattttgttggattaagaatgtttttttagaaatgttttatgggtttgtagaagttaagggttgagagagtgagaaggaaggaaggaatgtgtttgtatgtgtgagtggtttagtgtgtgaattaggtagagagagtgtgtggatgtgtttgtgtgtggaatggtagggatttgggaagtagttagtaggtagggtatttggtagttttttttggtagatatgtagttgggttattgtatagtgttggatgaatggtagtggggagtgaggggagatttgttgtttgtttatagggagtagtgtggtatagttagagaaagttgtattggggaggagaaattttagtttttttgtttttatttttggaggttggaaagtattttatgttttttgttgttattttaagtaagaggaaaaataggtttgttgtgaattatagttttatggttaaaatagaatgttagttaaaagtgtatggatattaagtttataaaataggatatgggtggtttttttgaaagaatataatttaataataaaagttttttgggatatatgtggattaaatgttttattggttttagtttttagtttttgaatagaggtattgttatgtttttgattgtattaggaaattagattttggaataaatgttttggtattttagggatgtgtttttagttgaaatgtaatatttttttattttgttaattaaatttataaatttttttatgaatagtttagttgattgttttttgtaaatatgtgaaaaatatgtattattaaaagtttaggatatgaatataagataaaggtagatatttttgttttaaattgattttaggtttttgagttgtattgattgtgattgggaatgaggttttttattttttagtggtgtttatatggatttattttttgattatttttttaattatttttttggttatagtattaatatgtaatattgaggtgtttttagagtgtttatgtttagggttttaggatatatgatatttaatggaggttttgttgttagatattagttattattttggatattaaatgattttaattataatgttaggagtggttggtttttggttttgggatattatgtagttattgagagatttatgagtggtttttgagattagtataaaaaagaaatagaaagttataaaaatgttaatgatgttattatgtaaatatatgtttttgtgttttgaaagatttttagtattgtagtgtttgagtataggagagttttttttatagttagtattgaaaataaatattggatataaataaatattgaaaagaaagattgttattttttgttggtgatagtggtgttttttgtaggttaataatggttatttatgttttagattagttttagaaaaaagtaagagtatttagggagggaggagagaggaataggggaaaggagaaggaaaggaaaggggatttgtaattgtttattattgatataggaagaataagaaggttagttgtttttttataggttttgattgtttagagatttataattaaagttagtttaagaagtttagtaaaggtagtttttttaattattttttttttagtatttttttttaaatttattttggtgagttttgtttttgggtttggtgagtatgggtgggaaagtatattgtgttatgttgattttttttttttgtttttggtaaaaattttatttgggtttttagtttttttggtttttttttttatttttttttgttggatatatatgttttagttgtgatttattggtttttttaggtgaagaagggtaaagattgatttggtttttttgttgaatgtgtttttagttttatttttttagtggtttgttgggtattgtaggtttgtttaaatatgagttattatttttaaatatggtgttttttttaatttttttgtgtttgtgtttagtattattgtttttttagttatttagattaaaattttattgttttttttgagggttgatttttttttgttttttatatttaattaagaggtaatttttaagttttttagttttataatttttttttttttattgtatt

SEQ ID NO: 789 - DNA, 9001 bp, Artificial Sequence
  chemically treated genomic DNA (Homo sapiens)
agttgatggatttgttaaattttttttttttttttttttttttatattatttgttagttataatggaattttttaggtttaagttaaagaaaaattggagagataaaattagattttgtagttttttttttttttgggaatgtttttttttttttttttagtttttgatgaatggttattatttatttttattaaatttaaataaggattgttgttttgtatgtttaattaggtaggtagagggaattggtttgtttaggaagtagtgattgagatgttttggttaagttagtgatagaggaggggagaaagaatttagattaatttgtatgtagtatattttatttttatgaaataaaatatatttgttttatatttgttgaaaagtaaaataataatattgtatgaaatgttatatatagggtaggttgtatatagtagttttagaaatattattgtatttattagagaaattattttaaaattgatatttatatattttttataataataataatatgttagaaatatatagtgtggtatttagtatatatatttttttgtttgtaagtgaaaaattttaattgtttttgtataatatgttttattttaaagtttaatttttaaaaatattgttgtgatattattaataattgtttttataaaattaatttgatattttgatatatatatatttttttagttatttaaatgttaataatgttaaatttaaaaaataataagtttatagtaatgttaaaatgttatatttagttaaatatttgtttgtgtatgtgtttttgtaattgttagaaatatttgtagtgaaagatgttagatattgaggatatttttttgaaattaaaggagttttttttttgatttagtggtttttttttttttatatagtttttttttttttttttttttttagtgtttatgattttttagtataatttttagttttttaagggtggagttgttttatttggtaaggttttaggattttggtgttgtgggtgtggtttatatgggttggtttattgtatattggtaagtatttaggttggaggttgggttttgtatgttggtgtagttgaagttggagtgttgttttgtttttagttttaggttggttaggtttgagttatatgtgtttttataaatatatggaggagttggtggtgtgtaaggataggtaggtgttggtattgtggaatttagtgatgggttatttaggttgtttaagttatttaggttgttgagattggagtttgggatgtttgttattgttgagggtattatgttggatgatatgtttatggatgagatagagttgggtggggaaaatatgttttgtgatgatagggggttgatgtttatagagttgaagaaggggaagtttttggtggatagggaggtggatgtaaggtttttggtggtttagttgttgtaggaatagtttgggtatatgttgttgtagggttgtatgagtttattgaattgtggtttgaagttatttttgtatagtttggtttgttggttgtgttttttttttttttatttggtttgatgatttttgaattaaatttgggggtggttggggtaagggagtaaatagatgttatagtgtagattattaaaatttttattggaggttaatttttgtttttttttgatatatatgttagtgtatttatatattttggttttgttttattgtattgttttgtatattaagatattagggttagtttttagttattggtttgggtttttattaagtgtaggagatttggtttgttttggtttgtgagttgggatttggagttatgttataaattttagttgaatgtatggagatttgtggatggtttgattatttagttaggtgtttttttaggtttaaaaatatttaatgtaaaataaatgtggggtagtaggtttttttaattttttttggggtattttgtaaatttgtttttattttaaagttatagatttatggatgaggagaaggggttggaagggtattagaggattgtttttttttttatgtaattttttttttttttttttgatttttattgttgttttttattttttggtatgtgtttttttaatagggattaggttgttaatatttttttttgtttagtaaaataattaaataaagagtaaaagattatttttttgttagtttgttaattttaggagtttggtatattaaattttgggaatttggaaagggtagttttggagattttttttttttttgttttgttttttttttattttaagtttattataggtttgtttgtgtgttaggtttagttgggttgtttggttttgtaggtggttatttaggttggttggtttttatttgtgtttggtggtttagttgtaattttgattttaatttatattgggtttttttgttgttttagatggtggtttttgtgtattggagagaggtttggtttgagatatttgagttgatattagtgatgttttatattatatatttttgttgggtttagttgtgtaatttgttttttttttttttttttttatttttgattttttttttatttttttttttttttgtatttgattgttataaaaagtatgttttatttttatttggtttgataagtagttgttttggaaggagaggtagttgtaaggagagtttagtgttgtggttataaagtattagggtggagttgtggaatagtgggtggggtgggagggtgtttttgaaggattttagaaaatttatagattttgtttttaattatttgttatttttattttaggttatttaaattttgtttaggtgagaagagtatgtgagaggtttgtttttttgatgtgtaagagagttaatgaaagattgattttgtttaaaattatgttgtttaggatttagttttggttttggatagttaaattaaaattatttttaatttttttttggttttttatttattagtatagttttatgttttgtataaatgttatttagagagtgtttttattttttttgatttgggagagtattttggtttttattttttttattgttgtttttttttttttgtttgttttgttttaattgggggttttattttttttatttagagtatttaattttttttttttaatagtaaagtttttggatgttgtttgatttgtttgattttgttttttgtttttagaattttaataaatttggaattttttattgattagtataaattaggatgttgttattgggttatttatttgagtttatttttgttaatttataaagtatagatttgttataaagttaaggtaagttttttttataaaattatgattataatttagaagagggggtgtgagttttaatttttagagtttaatttttgagagaagataaataaattaagtagaaaagttttttttttttttttttttttttttttaagaggattagtagttgtgtattaaaattttgtttttggagattataaaattaggaaatagggtgtgtgggagagatttgaatggttgaaataattgtaaagaaggtgtaagaagtgtgagtttaggagggaaaaagttgggttagggttgggataaaggttttttagggagggttaatttttttgtgtttttggtgggttttttttgttaaaggtttataggttggagtttgtttgtggtttttggtttggtagggattttattagttttgttttggtaattgtaagttaggaatataatgttttgtgtaggggattgtttatgtagtttagtttgtgagattgtgggatggtggggtagtgagttggtgttgttttgggagtttgagttagggtggtagttttgttggttttggagagggaattgtaattttgtaattaggttgttgtgaggttttttgtttttgtaaagttgtgttttattggtgtttttttaggtggtgttgttttttatatttttttttggtttatttggtttgtatttttataatattttttttttattttttttagattttgtgttggtttttatttggatttgggtttttgtaaggttggtttatatagtgatttttttgtgtgtggatatgtttgggtagtggtttttttggaaagtggtttttagtttttggagttgttggttggtaaagtgagtttgttgttgtttttgttgtttttttttagatgggtttttggtgtttatgtttttattttttttttgttggtttttatttttttttgaaaatgaaatatatatatttttttgttagtatgtttatttgtaatgtggatgttaattggattggtggtagaagttgtggaagagttgggttgtttggtgttggaggagggtgtgtgtggtggttttgggttgtgaggagtgttgtgtttgtggggtgtgtaggtgtaagtgtgggtgtttgtgttttattttttttttttttttagtgttgtatgttttatttatatgtttattttattgtagtggtatatttatttttatagtttgtgtttttaagtatatttatatatttttgtgtagatatattaaattttttgggatgtgtatatgtgtgtggtttatagattttttttttttttgtagaaagtttagatttttatgtggtttgggaaggttaggaaaagatgtggggatttggttgggtattgaagtttgttggtttttttttaaaaaaaaaaaaaaaatgtttttttgtgaagggtatttttgagtggttttaggtaattttttaatgagtggagttttttgggagttgaaagttgagaggaaaatagggatagaggttggtggtttttgaaggtttttgaattaagatgttgggatttttgtgatttaggaaatagaagggaggttagggtatgaatagagagggtggtagaattgtttgtgtttttagtgttttaggagttgggttggttgagggagaattaaagggatgtggggtagttaaaattttggtttttggaagttttgtggggagttaggtgaatgattatttttattatgtttttttttggaggggttgatttttttggggtgagagggagtgggtggtgtagagtagttgagtgggaatgtttgtagggtggtgtggtgttttatttgtggtttttgggttggaggtgttggagatggtgtgtatttttagtttgtgtttggaggagtttagtgattggggttgattgggagttagaattgaagttatggttaatggttggggatggtgataggaagatgaggagatggttgatagtttggtttttgttgtttggtgttttaagtgaagtgggttttttatgtagtttatggatgagggagtgtgatgttttattagtttttggttattgttttgttgagtttttgtagttgttgttgtttgttttgggttgtgttttaggtgtggagtttttttgttgtggggagagttaggggatgtaatttttgttgagtttttaagttaagttgtttttgttttttttggaaggtttaagtgaaaaagtttggagatggaaagttagtgggtaaatgaagatatgggatgtgggtagaagggtattatttagagtgtttttagggagtaggtttttaagttttaaagtgaaataagagtgggtaaagatttttttttttttttttttttttttttaagaatttttttaataaggaaagttaatgttgattgtgttttgtttgttttttttttatgtggtagttttgatagagaagtgttaagagtgatagggataggtaggtgatattagattttttgtggtggtagtagttgttgtagttatgatgtggttttttgagtgtattttttgtaatgtgtatatgtatattttttgggtggttgaataggagttgggttttgttgtagtttagttttaggtatttaggtgagtgatggattagatttgtggttttgtgtttttttgttggtttaatattttaaaattagaggtgggttttttggtgttgagatgttattttgttgtggttttttttagttttttttgtttttgtttttttttagatttttttttgggtgtgattgatgtggttttgtattaattaggatgttttgagttgtggtggagggattgttttgtttgtatttattagtagtgtggggttgggttattgttttgttgtgtgtattgggtttatataggtaagtttttgggaatttagtttttgtttagtttaaggtgatttggtttttagtatgaatttaaaggtgaagagatgaggttaggagttgaaggtttgggagaagagagtggaatggttaagaagagaaaggtataaggattaataagatatttattttttgtgttttattatatttatttttaattttttattttatataaaaaggagatatgttatttaaaattagaaaatttgaaaaatagtaataaattatttttttgattttaaattttttaaatagtttgttaagtgaatgttgtgttaatttgaagaagttttaattgtaaagaagatagagttttgaaaaggtaggttaataaattagaaattgagaagtaaatggatttgttaaaagaaaattattttgattttaaatgaataattgtttggtggtttattttggatttatataagaataaaaagttgttttagattatgttttttgtgatgtttattagtttttagatagaaaatatataatagaagagaaattttaatttagtgtttttaaaatgttgaaagtttatttattttatttaatgttgattaagatatatattttagattttttaaattttttgtatattgtattaagtttgttttaatttgagagagttatgttttaaatttgatttttttgtttattttattattaattagatttaaatttataaagtttgtagaattaataattttgagttaattatatatgaaatatgttttaatgaatttttatataattaagaatgttgttaaataattaattttaaggataatttttaatagttattttttttttttagtgagtttaaggttgttttgagttattaaagtttaagtaggtagaaggggtgtgtgtgagttaagggtgaaaagtttagaattgtgtttaattagtaaaagtaaaattttatttatataaaataaaaaaaattatttttggagatattaattttttatagtattgtttttaagtaaatttaatttttaaagaaattaaagaaagaaatttaaatatatttaaaataatttttgaaagtttttttgttttttagtataggttagttggagaggataaattaattttttttgggtttttgtatgggtgattgttttattatggagttagtgttattatttttgaatgtgtatttgtttgatattatagttaatgatttgtaatgttagtatgaagtatttttaaaatattttttttttgtttttgtttataagattgggaaatttatttgatgtggaataaagtggatgaagtagattataaatatatttgtaatttatgtgttttttttttgttttgattatttttaaattttatttgtaatttttttttattttaaatttgtagtttaaagatgtatatgagaattgttttttagtttttttttattagtattattttattttaagaataatttagttgtaagggaggaatttttttatagtaagttttaaattagtatttttgtttttaattttttattttattttattttattttatatatatagatatttgtttagagtaaaatatatttttatgtgataggtttgtattagttgaggtttatatatttagttatattaggttttgtaattttattattaaattatatatattatattagtagtttgttggtaaagaaggttaaattaatttatattttgtttattatttggtgtttaaatgatgtattttattttggagatttggtggagaattttttttttagattttatagtgttttattgaagataatgtttttatatttgtagtggtttttaatttgataagattttaatttgtttaagttttttaaataagggttttaaatgtttttagttgtttttttattgaattttttttaatttttttaagattataaagtatatgtgtaaagtaaatatttttttttattgtattgttagttgatgatttataattaagttaataagaatttagtttttttttgttgaatgtgtttattaattatattttagtttttttttttaaattttagaatagttgtggtttttataatattatgttttttaaagttttattttatgaagggattttattatattaaagaatgaaaaaaatttttattgtagttagtatatatagttttttattttttgttttttaagatttaaattttagagttgtaaatatttttggaagtttgggtgttaatgttttattttagaaagttgagaagttttatagagttatatagatttttaaatttattttttataaatttatagaattttgataaaagttttggtggttttattttattgatggaatttttattatgataaatatatatgtatgaaggattttaattagtttttaaagtggttgaaaaatttaagggtatgtgattgttttttatagtgttaatgtgtgtgagatgttggaagtattggggattagtagtagtttagatgtttaaaaagataaggtgttttaatttgtgtggatttattgaagttaagtggtgaataaagataattatttagataatttagattaaagtaaaagtaaaattatatttatttgtatatatatatttatatttattttatattatagatatatatatgtatatatatattggttttgtaaataattgatttaaagtgaggattttttttgtatttttttagtaggagttttaatatttttttaattttttaattattttata

SEQ ID NO: 790 - DNA, 9001 bp, Artificial Sequence
  chemically treated genomic DNA (Homo sapiens)
tgtaaagtgattaggagattaggagaatgttgaaatttttgttggaaaaatgtaaagaaaatttttattttgagttagttgtttatagagttagtgtgtgtgtgtgtgtgtgtgtttgtaatataaaatggatgtgaatatatatatataaatagatatggttttgtttttattttaatttgaattatttagataattgtttttatttattatttgattttaatgggtttatataaattaggatattttatttttttaggtatttaggttgttgttgatttttagtgtttttaatattttgtatatgttggtattatgaggagtagttatgtgtttttgggttttttaattattttggaggttgattgaggttttttatatatgtatatttgttgtgatgaaagttttattggtagagtggagttattagagtttttattaaaattttgtgggtttatgagagatgggtttagaaatttatatggttttgtggggttttttggttttttaaaataaggtattaatatttaagtttttaaaaatatttgtagttttggggtttgaattttgaaaaataaggagtgaggggttgtgtatattaattatagtggagattttttttattttttaatgtgatggagtttttttatgaaatgaagttttaaggggtatggtattgtggggattatagttattttgaggtttaaaagaagaaattggaatatgattagtaaatatatttagtagaaaagagttggatttttattgatttagttataggttattggttggtagtgtaatgggaggaaatatttattttatatatatattttatgattttgggggaattagaggaaatttaataagaaaatggttagaaatatttaaaatttttatttaaaagatttaagtaaattagagttttattagattaaaaattattataaatgtaagagtattgtttttagtgaaatgttgtggggtttgagaaggagattttttgttaaatttttgggataaaatgtgttatttaagtattagataatgagtagaatgtaaattaatttaattttttttattaataggttgttagtgtaatgtgtataatttagtgataagattgtaggatttaatatagttggatgtatgagttttagttaatgtagatttgttatatgaggatgtgttttattttgagtaggtgtttgtatgtgtggaatggggtaaagtggaataaaaggttaaaagtagaaatgttgatttaaagtttattatgaagaaattttttttttgtagttaaattatttttaaagtgggatgatattggtgaagaaagattgaaaaataatttttatgtgtgtttttggattgtaagtttaaaatggggaggagttgtagatagggtttgggggtggttagggtaaaggagagatatataagttgtaaatatatttgtagtttgttttatttattttgttttatattgaataagttttttaattttgtgaataaggataaggagggagtgttttaaagatattttatgttggtattgtaaattattgattgtaatgttaaataaatatatatttagagatgataatattaattttatagtaaaataattgtttatgtagaaatttagaggagattagtttgttttttttagttgatttatgttgggggataaaaggatttttaaaaattattttgaatatgtttggatttttttttttaatttttttggaaattaaatttgtttggaaatagtgttataaagagttgatgtttttaaaggtgattttttttgttttatataaataaggttttgtttttgttagttgagtgtagttttaggttttttgtttttagtttatatatattttttttgtttgtttggattttaatggtttaagatagttttgagtttattgggaaaagaaaatgattgttaaaaattatttttgaaattggttatttggtaatatttttaattgtatggaaatttattaaggtatattttatatataattagtttaaggttgttgattttataggttttatggatttaaatttgattgataataaagtaaataagagagttgaatttaaagtgtggtttttttgggttaggatgagtttaatatagtgtataaggaatttgaaagatttaggatatgtgttttaattaatgttaagtagaatggataagtttttagtattttgaaaatgttgggttagggttttttttttattgtgtgttttttgtttggggattaataagtattatagagaatgtgatttgaggtgattttttatttttgtataaatttagagtgaattattaaatagttgtttgtttaaagttaaggtaatttttttttgatgggtttatttgttttttgatttttaatttattagtttgtttttttagggttttgttttttttgtaattaaagtttttttagattagtgtagtatttatttgataggttgtttggaaaatttaagattggagaggtgatttgttgttgttttttaaattttttagttttaagtaatgtgttttttttttatatggggtgggggattggaaatggatgtagtgagatataaagagtgggtgttttgttgatttttgtatttttttttttttgattattttattttttttttttaagtttttgatttttagttttatttttttatttttgggtttgtattaaaagttggattgttttgggttgggtaggagttgaatttttgggagtttgtttgtgtagatttagtgtgtatggtgaggtagtagtttggttttgtattgttgataggtgtaggtaggatagtttttttattgtggtttggggtgttttgattggtgtggagttatgttagttgtatttggagaagggtttgggaggaggtggaggtggagagggttggggagggttgtggtggagtgatgttttggtattaggaagtttgtttttggttttaagatgttaggttaatagggaagtgtggagttgtagatttggtttgttgtttgtttgggtgtttggagttgagttgtggtaaggtttggtttttgtttgattgtttgaggggtgtgtgtgtgtgtgttgtggagggtgtgtttagagggttgtgttgtggttgtagtggttgttgttgttgtaggggatttaatattatttatttgtttttgttatttttgatatttttttgttagggttgttgtgtggggggggggtgggtagagtgtggttggtgttagttttttttattggaggggtttttgggggagggagggagagaagaagggggtttttgtttatttttgttttgttttggagtttggaagtttgttttttaaagatgttttgagtggtgtttttttgtttatattttatgtttttgtttgtttgttgattttttgtttttggatttttttgtttgagttttttggaggagatgggggtagtttggtttgagaatttggtgggggttgtgttttttggttttttttgtagtggggaaattttgtgtttagagtgtgatttggagtgggtagtggtggttatgggggtttggtggggtagtagttaaggattagtagagtgttgtgtttttttgtttatgaattgtatgaaaggtttgttttatttggagtattgagtagtggggattaagttgttggttgtttttttatttttttgttattatttttagttgttagttatggttttggttttggtttttggttagttttggttgttggatttttttaagtataggttggaggtgtatattatttttgatatttttagtttggaggttgtaggtaaggtgttgtgttgttttgtagatatttttgtttagttgttttgtgttatttgtttttttttgttttaaggaagttagtttttttggggggaggtgtggtgggagtggttgtttgtttggttttttgtagaatttttgggagttggaattttgattattttgtatttttttagtttttttttgattggtttggtttttggggtgttaagggtgtgagtaattttgttgttttttttatttgtattttggttttttttttgttttttgggttataaaaattttagtattttgatttgaggatttttagaggttgttgatttttgtttttgttttttttttggtttttagtttttgaggagttttatttgttaggaaattgtttgaaattatttagaaatgttttttgtgaagaggtattttttttttttttttgggaaagggttggtgaattttggtgtttaattgaatttttatatttttttttagtttttttaaattgtatggaaatttgagttttttgtgagggggaggggggtttgtaaattatgtgtgtgtgtgtgttttaggagatttggtgtgtttgtgtagaggtgtataaatatatttgaaagtataggttataaaagtgaatgtgttgttgtagtgagataaatatgtaaataaaatgtgtggtgttgggggaggggaggaaatggggtgtggatatttatatttgtgtttgtatattttataggtgtagtgttttttgtggtttggagttgttgtgtgtatttttttttggtgttaggtagtttagtttttttatggtttttgttgttggtttagttggtgtttgtgttgtaggtgggtatgttgatgggaaagtgtgtgtgttttgtttttagagaaagataaaagttagtaggggaagaatgaggatgtgggtgttgaggatttgtttaagaagaagtggtaaaggtggtagtggatttattttattagttagtagttttaggagttggaggttattttttagaggaattgttatttggatatgtttatatgtgaagaaattgttgtgtggattaattttatggaagtttgagtttgggtaggagttagtatggagtttgggagggatggggggaggatgttgtggaggtataggttaagtagattaggagagaatgtggaaggtagtgttgtttgggagggtgttggtggggtgtagttttgtaaaggtagaaggttttgtggtggtttggttgtgagattatagttttttttttgaggttgataggattgttgttttggtttaggtttttagagtggtattggtttattgttttgttattttgtgattttatgagttgggttgtatgggtaattttttgtataggatattgtgtttttggtttgtagttgttagagtagagttaataaaatttttattaggttaagagttgtgaataggttttaatttgtgagtttttaataaggaaaatttgttagagatatggaagagttggttttttttgggaaatttttgttttggttttggtttagtttttttttttttgggtttgtgttttttatattttttttatggttgttttggttatttaggttttttttatatattttattttttagttttgtgatttttgggagtaaagttttaatatataattattagtttttttagaaggagaaagaaaaaaagaagaaagatttttttgtttggtttatttatttttttttaggagttgaattttggaaattgaaatttatatttttttttttaaattataattatagttttgtaaaaagggtttattttaattttgtagtaaatttgtattttatggattggtaaaaatgagtttaaataaataatttaatagtaatgttttggtttatgttggttggtggaagattttaaatttgttaggattttggaagtagaaaatagaattaagtaaattaagtggtatttagaggttttgttgttaaaaaaaaaaaattaagtgttttgggtagaaaaaataaagtttttggttagagtagagtaaataaaaagaagaaaataatgataaaaagaataaagattaaaatgtttttttaaattagagggaatgaagatattttttgggtggtatttgtgtaaggtatgaggttatgttggtggataaaaggttgggaagaagttgaaaatggttttagtttaattgtttagagttagagttgggttttgggtggtgtggttttgagtaaggttagttttttattagtttttttgtatattaagggaatgggttttttatgtattttttttgtttgagtaaagtttagatggtttagggtagaaatggtaagtaattaaagatagagtttatgggttttttgggattttttgaaaatgtttttttattttgtttgttattttgtagttttattttagtgttttgtagttgtggtgttgggttttttttgtagttgtttttttttttagggtggttgtttgttgagttaagtgggagtgaggtgtgttttttatagtagttgggtgtaaagaggaagggggataaaaaggaaattaagaatgaaaggaaaaagagaaaaagtggattatatggttgggtttggtggagatgtgtaatgtgaaatattattggtgttagtttggatattttaggttaggtttttttttaatatataaaagttgttgtttggggtgatagggaggtttgatgtggattgggattggggttgtggttgggttattggatatgggtggaagttggttggtttgggtggttgtttgtaaagttaaatgatttggttgggtttggtgtgtggataggtttgtggtgggtttagggtaaagaagaggtagagtgaaagaagggggaatttttaaaattattttttttgggtttttggagtttaatatgttaagtttttggagttaatgagttgatgaagaggtggttttttgttttttatttggttgttttgttaggtgagaaagagtgttggtggtttagtttttgttaagggagtatgtattagggggtgggggatgatagtggaggttagggaaggaagggaggaattgtgtgggagaaagagtgattttttagtgtttttttagttttttttttttatttgtgggtttgtggttttggaatggaagtaagtttgtaaggtgttttgggaagggttggaaaagtttgttgttttgtgtttgttttatattaagtgtttttggatttggagaaatgtttggttgagtgattaaattgtttgtaggtttttatgtgtttggttgaggtttgtggtgtagttttgagttttagtttgtaggttagagtagattaggttttttgtgtttggtggagatttgggttagtaattgaaagttggttttggtattttggtgtgtagggtggtgtagtgaagtgaggttagggtgtgtgagtgtgttagtgtgtgtgttgggggaaggtgggggttggtttttgatggaagttttagtaatttgtattgtggtatttgtttgtttttttgttttaattgtttttaggtttggtttaagaattgttgggttaaatggagaaagagggagtgtaattagtaggttgagttatgtaagaatggttttgggttgtagtttaatgggtttatgtagttttatgatgatatgtatttaggttatttttataataattgggttgttaagggttttatatttgtttttttatttattaagagtttttttttttttaattttatgaatgttaattttttgttattatagagtatgttttttttatttaattttattttgtttatgagtatgttgtttagtatggtgtttttagtagtgataggtgttttgggttttagttttaatagtttgaataatttgaataatttgagtagtttgttgttgaattttgtggtgttgatgtttgtttgtttttatgtgttgttgatttttttgtatgtttatagggatatgtgtaatttgagtttggttagtttgagattgaaagtaaagtagtattttagttttggttatgttagtgtgtagaatttggtttttaatttgagtgtttgttagtatgtagtggattggtttgtgtgagttgtatttatagtgttgggattttaggattttgttggatggggtaattttgtttttgaaagattgggaattatgttagaaggttgtgggtattaaagaaagggagagaaagagaagttatatagagaaaaggaaattattgaattaaagagagagtttttttgattttaaagggatgtttttagtgtttgatattttttattataagtatttttaatagttgtaaggatatatatataaataaatgtttgattggatatgatattttaatattattataagtttgttattttttaagtttagtattgttaatatttaaatgattgaaaggatgtatatatattgaaatgttaaattaattttataaaagtagttgttagtaatattataatagtgtttttaaaggttaggttttaaaataaagtatgttatatagaagtgattaggattttttgtttgtgagtaagggagtgtatatattaaatgttatattgtatgtttttaatatattattattattataaaaaatgtgtgaatattagttttagaatagtttttttggtggatgtaatgatgtttttgaaattgttatgtataatttattttgtgtataatattttgtataatattattgttttattttttagtaaatatgaaataaatgtgttttattttatgggagtaaaatatattgtatataaattggtttggattttttttttttttttttgttattaatttggttaggatattttagttattgttttttaaataaattagttttttttgtttgtttagttaaatatataaggtagtagtttttatttaaatttggtagaaataaatgatagttatttattagaaattaaaaagaaaaaaaaaggtatttttgggggggaaaagggttataaaatttaattttgtttttttaatttttttttggtttaaatttagaggattttattatggttagtaaataatatgaaaaagaaaaaagaagaaagaaatttagtaagtttattagtt

SEQ ID NO: 791 - DNA, 4001 bp, Artificial Sequence
  chemically treated genomic DNA (Homo sapiens)
gagtttaatgtttgtgatttttttttttttaaaaatttttgaggtaatatttatatttagtgaaatgtatagattttaagtggattattttattagtttgataaatgtttgtaaggtggaatttaagtttttattagtatttgttaaatttatgttagaggttgattagagaagtatagtttttaagatttttattttgttttgtggagaatggtaaaaatttgtgaaatattttagtagagttaggagagagtaatattggtaatgtgaagtatgttaagttaagaaaggaagtattgaaattaattgttttgaatggaatttgataagaatttgttattttatttttttaagattggatttaagttgggagagaatattgttttttgttttgtttaagttaatattattgtttagatttataaatttttttattttttaatgtttatatattaatttgtattataagttaaaataatatagagaatttggaaaaagaagaaggggaatgttttttatgaaaagtatattttttaaagtgtttggtttgagagttatatagtatgtataaaatttgataataagtatattatgatttatattgtatataataaaaagtagggtatttttgaagggttttgagaaaaagttttgggtttttaaaatttgtttaagaaggtgattaatggtatattatttttaaatgtagtattgatttgtatgttttatagttattaatagtgaaaataatagtttttaataagagttggaaatattgagttgagggttttttttttttttttaaagtttgaggttaaaattgatatttatttttttgaattatgtttatattttttttttggttaatatgtatgtggtggtataattttgaaaattatgtaatgttatagaattattatttagaaatgaattttgttaataaattttttgtatttaaattttttttattgtatagtttttgataatgttttttagataattttttttttagtaattagtatttttaaataaaaattatagagaatagtaagtttttttttttttttttggtagatttgatttagaaattgttatgggaagaaagtgttaattatattaaaaaatagtttgatagaaagtatttaaaaagagaaagggagaatattatgtttttattttggtgaattagtaataaagaaaaagattagtatggatgggtattttttaaaaatatatttttttttttttggtttttgttagggtggaggaagttgtttttttgttagagatagggtggaagagagtgaaaggataaatgattgagaggttgtttttttttattggtgtaggtgtgtgggggttggatggggggttgtggaggggggaggtggttagtaggtgtttgggttttaggtttttatttttatttttgtttttatttttatttatatttagggattggttttgttttttggtgggtgagtggtaggtgttgaagtattggggtggggggtgtaaattttgtgggtagtggaaaagaggttgtggggggttttttagtgttggtagatattgtgaggttggtagttgttggtatgtatatttagtttgtagttttgaggaatatgtttgtagttagggtgtggagtagagttttgggtaggagaattaagggagggtgtgtgttgtggtggtggtggtagtggtagtggagttgttagtttttttttttttgagtgagagaatgttatatttaggaatatagttaattagggaagtgaaagatttttataatgagaattattaaatattgtttaaagaaagtatagatgatattaattaatggaaaaatattttatgattatggataggagagagtaatattattaaaatggttatattgtttagagtaatttatggatttaatgttatttttattaaattattaatgatattgtttatagaattagaagaaattattttaaaatttatgggttgtgtttggggtgttgtttttgtagtttgtggtgtttttgtttgtgtttttgtagggttttttttgtgttgttgttgttgggggtttgggtgtttgtggtttggtgatggtagtggttgtagtgggtatggttgaaggattgggaggtggtggtttggtttgaattgttgtgaagaaagtgtaattatgttttgttttgtgggttaagaaattggagaaatttggagtgtattttgtttgtaaggtatgtgtttgttgtttttggattgtggatgggtgttaggggtttagtttgtgggattttttttttttttttgtttttatttttgttttttgttttttgttttttgttttttgtttggggttgttgtattgtggaagtgtttttgttgtttgtgtttaattagtttttttttggataagagttttgttgggtttgaagaagggggattattaagatggagagttttttattttttttgtttgaaaggagtagttttggtatttgagtttttgggttattttggggttttgttgttttgtaggagtttgttggagttatttttttgggagtggagtggtgttttttatgtggtgggtgatttaggggtaaggaaaaattttttgggggattgagtggttttttttgtaattgatttttttttgtgttttattgggaggaattgggtgtaaggagtgggggtggagaagatttttggatttttggtgttttgggaaagtgaaggggaggaaagtgtggggtgggaaggtgggtagagtttgaggtgagggttttgtggtgtttggtgtttttggttgggggtggaggtattgttgtgtgtggtgatagttttgttattattgtattattatttgtttagttaaaatgttgttttagttgtttgaggtgtaaataggatttggtaaagtgatagtttagtgtggtgggtgttattgtttagtttgaggatatttattttttgttatttattttttatgttagtttaggtattttgttatttttagttgtagatttagatgtggaggttgtgtttttgaggtgggaggattgtttgaggttgtggggtaggttggttttgtgttgttagtagtggttttgttttgatagggtgatagttgaggggggtggggatttggttttgttagtttttgtggtttgtggttgaggtagggaagagatatatttatatatatttatatttttttgtattttttttgtttgttgtaaagagggttaagtttttagattttagatttttgattgttataattaagttgtagtgattatttttgaattttgatataattataatttattttattagaatatttaggttatattttttttggtatttgtaggagttttttagttataatggaatgtttatgtttgttttttttttatattatatgtttaggtttatgttaagtatttttgtattttatattggtttaataaatatttgttgagtgaatgtaggatttagtttagtgttttttaaattttaatgtgtatgggaattttttggggaagttggttaaaatgttgattatgaattaggtggtttgaggtggaagttgagagtttgtatttttgataaatttttaagtgatgttatgttagtttatagattatattttaatttagatttggataatatattatttgttttttttgattttagtagaaaagatagaaataaataataatgttatgtggttatttttgaagaaggaatgtaaaaaagatgaagtggggagtgtgtttttaagaaaggtgtaagtttaggagttgattatgaagggtattagatgaatgagaataggatattgattgtagtaggtagaagggtgagttatgtatagaattaagaataaggttatgggtatagggtatattgtttgggtgatgattatattaaaattttataaattattattaaagaatttatgtaattaaatattatttgttttataaaaattt

SEQ ID NO: 792 - DNA, 4001 bp, Artificial Sequence
  chemically treated genomic DNA (Homo sapiens)
aggtttttgtggaataggtggtgtttgattatataagttttttaatggtgatttgtgagattttggtgtagttattatttaagtagtatgttttgtatttatgattttgtttttaattttgtatatagtttgtttttttgtttattatagttggtgttttgtttttatttgtttaatgttttttatgattaatttttgggtttgtattttttttagaagtatattttttattttattttttttgtattttttttttagaaataattatatagtattattatttgtttttgttttttttgttaaaattaaaggggataaataatatattgtttaggtttgaattggaatgtggtttgtggattagtatagtattatttgggagtttgttagaaatgtaaatttttagtttttattttagattatttgatttataattagtattttaattagtttttttaggagatttttatgtatattaaagtttgaggagtattgggttagattttatatttatttaataaatatttattgaattagtgtaggatatagaggtgtttaatataaatttgagtatatggtgtggaaaaagagtaagtatagatattttattgtgattgagaagtttttgtaagtattaagaagagtataatttagatgttttagtagaataaattatagttatgttaaaatttagaagtggttattgtagtttggttgtgataattgggaatttggaatttgggaatttgattttttttatagtaggtaggaagaatatagggaggtgtgagtgtgtgtgagtgtgttttttttttgttttagttataggttgtaggagttgataaggttaagtttttgttttttttagttgttattttgttaaaataaagttgttgttgatagtgtagggttagtttgttttgtggttttgggtaatttttttattttgggaatatagtttttatatttggatttgtagttggaggtgatagggtgtttaaattggtatggagagtgggtagtaagaaatgggtgtttttaaattgagtagtagtgtttgttgtgttgggttgttattttgttaaattttgtttatattttgagtagttgggatagtgttttaattaaataagtaataatataataatgatagggttgttattgtgtgtggtagtgtttttgtttttagttgagggtgttaggtattataagatttttgttttggattttgtttatttttttattttgtgttttttttttttttgtttttttaaagtgttaggagtttgggagttttttttatttttattttttgtatttagttttttttagtgggatataggaagggattgattgtagaagggattatttagttttttaaaagatttttttttgtttttgggttatttgttatatggagagtattgttttatttttgggaaagtgattttagtgagtttttatagagtaataaaattttaaggtagtttgggagtttggatgttgaagttattttttttaagtggaaggaatgaagggttttttgttttagtgattttttttttttaaatttagtaggatttttatttaagaagaagttaattgggtgtgggtgataagagtatttttgtggtgtagtggttttaggtgggaggtgagaggtaggaggtgggaggtggaggtggaagtgggagggggaggggggttttgtgggttgggtttttagtatttatttgtggtttgagagtggtgagtgtgtattttgtaggtggagtatattttgagtttttttagttttttggtttgtggagtggagtgtagttgtgttttttttatggtgatttgggttgagttattgttttttggttttttggttgtgtttgttgtagttattgttgttgttggattgtaggtgtttgagtttttggtggtagtggtgtagggggagttttgtgggggtgtgggtggaagtgttgtaggttgtgggggtagtgttttgggtatggtttatgaattttaaaatagttttttttagttttgtgaataatgttattggtagtttaataggaataatattgaatttataaattattttgggtagtatggttattttaatgatattgtttttttttatttatgattatggaatgtttttttattagttgatgttgtttgtgttttttttgagtagtgtttagtaatttttattatagagattttttatttttttggttagttgtatttttaggtatggtatttttttatttaggagggaggggattagtggttttgttgttgttgttgttgttgttatagtatatgtttttttttggtttttttgtttgggattttgttttgtgttttggttgtggatatgttttttgggattgtggattaggtgtgtgtgttggtggttgttagttttatggtgtttgttagtgttgggaggttttttatggttttttttttgttgtttgtggggtttgtattttttattttagtgttttgatatttattgtttgtttgttagggggtgaggttaatttttgggtgtgggtgagggtggggatgagggtgggggtaggggtttggagtttaggtatttgttggttattttttttttttgtggttttttatttgatttttgtatgtttgtattagtgggagggggtagttttttaattatttgtttttttatttttttttattttgtttttgatagagagataattttttttattttagtgggagttagaggaaaaaaaatatatttttgaaaagtatttgtttatgttaatttttttttttgttgttaatttattaaaataaagatgtgatgttttttttttttttttttaaatattttttgttaaattattttttaatataattaatattttttttttatagtaatttttgggttaaatttgttggaggaggggaaaaaaatttattattttttgtaatttttgtttgaaagtgttggttgttaaaagaaagattgtttaaaaagtattgttaaaaattatgtagtggaaaaagtttgaatataaaaagtttgttaataggatttgtttttgggtggtggttttataatgttatgtagtttttaaaattgtgttattgtgtgtgtattaattaggaaaaagatataagtataatttaaaagaataaatattgattttggttttaaattttaaaaagaaaaaaaaaatttttaatttagtgtttttaatttttgttgaaaattgttgtttttattgttgatgattgtggagtatataagttagtgttgtgtttgaaagtggtgtattgttgattgtttttttaagtaggttttaaaagtttagggtttttttttaggattttttagaagtgttttattttttgttatatgtaatgtgggttataatgtgtttattattagattttatgtatgttgtatagtttttaggttagatgttttaaggggtgtgttttttgtgggaaatatttttttttttttttttttagattttttgtgttattttgatttgtaatgtaggttaatatataaatattgggaggtgggggagtttgtagatttaaatagtgatattagtttagatagggtaaaaggtaatatttttttttaatttgagtttagttttgaggggatgaaatggtagatttttattaggttttatttaggataattaattttagtgtttttttttttagtttgatgtgttttatgttattagtgttatttttttttggttttgttgagatgttttgtagatttttgttattttttgtaaagtagggtgagagttttaaaggttgtgtttttttgattaatttttaatatggatttaatagatattaataagagtttgggttttattttgtaggtatttgttaaattgatggaatgatttatttgagatttgtatattttattggatataaatgttgttttaaaaatttttaaaaaaagaaaaattataagtattgaattt

SEQ ID NO: 793 - DNA, 4001 bp, Artificial Sequence
  chemically treated genomic DNA (Homo sapiens)
tgtatttttttttttttttagtttttattaatttttgaaaaaaaatttttttaattagaaattttgtgagattgttttttttttagttttgattttaatgtttaagaaagatggtattattttttttgattatgaaaatttagatttttattattttttagaaatgtgatgagtgtgaagattattttgaatatttttaagttattagtttagttttttttttatggattatagtattgattttgttaattgataaaaataattagaaaatgttttaatgatatggtataaattatgaatattagaatttattagttttttttttataatttttttttattaatatgtaattgtaaaagaagaataagaagggaatgggggtaatggatttaggtttaaaatatatattttatttttgtttttttttatggttttttttggtatgtatgttgtatatttttaatatttttaagatattaaaaatttattaatttaagtatatttaatttagatttagttttagtttagatataatgtttgatttttaagagtttaaaatataattaaaaatgtaaatatttgaaattagtgttatattgagagttttttaaaatttaaatattaagatatatattttttttattaagatttgatttttaatatatattttttaaggtaattaaagggaatatttatttttgtttgaggaaaaaatattttgtaagttaaaatttttattaatatagtattttattatatgattttttttttttattttaaaataatggggtttaattttttgaagtgtagtttttttagtaataaaggtggataaatttgtttttttttgtaagtagatattttttaaaggtaagaaagggaagattttgttagtttagtttattatagttaatgttttttttattaagtgtttaattgttttgaaagttagatgttttagaaagttagatgttttatagttgttttggtggtaattattttaagatagtggtattaaaggttttgatttttagtttttttatttaaaaaatggggatattaattattttataataaagttttgatgatataatgagattataaataaaatattttgtgatgtttgatttattatttaattaaaatttttataatggatttatatttttggtttagttattatatattttgttaagtggtttttttttaagaaaaattggggatgggggggttaggggggtgggagagtagtagggagtaggaggtagggaaggaggaaaataagtaaaattagtatatatataagtttttttatttttgattgtttgtgttttttgtgttttttttttttaagtttttttaggtttatgttttgaatttttttttttataaatgaaatataatggatatgaattatagagaattttatggaagatattggagtttaagtttgtagattagttttttgtttataagtggaggtgattggaaaattaagttaaataagtgttggataattttaaatagttaaagaagttttaatgggatagggtttaggtttattaaaggaggtaatattagtaattgatgaaattatagtgatggttgattgattatgatttgaggtataagatgttaaatttaaggttattaattaatgtgtgtaagaagtggttttaattgatttgggtgatgttaattgtgtaattattggttgttgtgttattttaggtttaggaatagtttagtttgtaatagggagattttaattagggagaggaggagtggggtaaaggggttgggtgttttttaagttgttgtgtgggatgtggaagggatgaaagaggtgaggaagagtagtaaattaatttaatatatttatatttttgttgtgtttttaggattatgagaagtgggtagggggtgatttttggttttttttattttgtaaaggtttttaattgggttttttggttaattttttagttattgttattttgaaattttgtgtttttttgtattttttatgttattttttatttttttgttttgtttttttttagtgttgtttgattttggaattatagagaatatttaagaattttaggattagagttttttttggttttatataatatttaattggttggttgttggttaagagtttgttttattgtgtttatttagtataataggaattagaagaagatagttgttaattgagtggttgatggttttgttttttgagttggaggtattttgatttagttgttgggagtttggtatgttgagttgtttgagaatggtatattttgtagataaagaagtgttttgtgttttttgttttttggaattattttagtttttgtatttttttgttttttatgatttaagtaggtgtgattttttaggggtgtttttgtgtgtaaatgaatatttagataatatttgttattgagtttaatttgttttgtaagtattaggttattttatgtgagtgtttagtatgtgtggaaatttaatagataggtagaatagaatgtttgtagattatttgaataaataaattagtatttgtattagagttgtagattgtttatatgggtggtgatttattatttgttagtagtgttttgaagaagaaatatggggatatatatgtagttggttttaagttatatgagtggtaaggttgatatatattggttatatttttgattggtttttttattagttaaaagttttttatgatgttattttatgtatgggattttttatttaattttagtttttgttttttttttattttttattttttttttttgtgagttagtttttatttattttttttaaaggtaagtttaaatatttaaaaaattattttagaggatatgtttggttatttttaattttaatttgattattttatgtaggaaggttatttttattattagttataaatattttaaaatattgatggagatatatattaatttttagtagaatttttaaattgtttttgaaggtataagattggttttatatttaaatttatttttgtgttaggaaatttttgatttgattttagattgaatttgagtgttagaaagtaatgatgagatattgtaggttaaagttgataaattaggtagtatataaaaaagaaaataattttgaattgtgaaggtgagttaagttgtaatgttttgtaattagtttttttttttttttaatatattagtgattatagttttgtaatttgttttgaaaaataatgtaagaagagaaagagaaaatagtgtatgttggaaatattaaagttttttatgtagttaaaattttatatgtagttattatttttaagatatgttgagtagtttttattttaatatattttttgtatttggatgggagaattaattataataaatatagtttggtattaatagtatattaataattttgttagtatagattaaaagagtttttatgggaattattggttggtaaaggatttagaaaataaatatatttgtagagatttagtggaattattaataggtttttatagtttttggtgttttttaaaattaggtaattagtgaaatggtttatttaatgtgttatgtagtaaaggtagttgttttttttttgttagtgttgaaaatgaaattatatttttttttttgaaagtttataataaattatgatttttttttaaatgataaatgttttgagtagtgattttttattttgtattttaaatgtaatatgtgtagttgtgttttgtttttttgttttttaaatgttttagtgtttgaatatttatttgagtgatatttaattattatagttggttagggttgattgtagtgattgaaataggattttgatgtttttagttttgatttttattatttttaaatttatttggtttatattgtgtaattagtagatgtttatagattagttttttgttttaattgaagtatattgttata

SEQ ID NO: 794 - DNA, 4001 bp, Artificial Sequence
  chemically treated genomic DNA (Homo sapiens)
tgtaataatgtgttttaattaggataggaagttgatttgtaaatgtttattgattatataatgtaaattggatggatttgaaaatggtaaaaattaaaattaaaaatattaaggttttgttttagttattgtaattaattttgattaattgtgataattaaatattgtttaagtgaatgtttaaatattgaaatatttagaagataagaaagtaaaatatagttatatatattgtatttaggatgtagaatagaaggttattatttaaagtatttgttatttaaaagaaagttataatttattataagtttttagaaaaaagaatataattttatttttaatattagtaaaaaggaggtagttgtttttgttatatgatgtattaggtgggttattttattaattatttgattttagaaaatgttaaaggttatggaagtttattaatggttttgttgaatttttgtagatgtgtttgttttttaaattttttgttaattaataatttttatgaggatttttttagtttatattgataaaattattaatatgttgttgatgttagattgtgtttgttatagttgatttttttatttaagtataagaaatgtattgaaataaaaattgtttagtatattttaaaaatagtagttatatataaaattttagttatatgaaagattttaatatttttaatatatattgttttttttttttttttttgtattgttttttaaaatgagttgtaaaattatgattattaatgtgttaggaaagaaaaaaaattagttgtaaaatattataatttagtttatttttgtagtttaagattatttttttttttatgtattatttggtttattagttttaatttataatattttgttattgttttttgatatttaaatttagtttaaaattaaattaagaattttttaatataaaggtaagtttaggtataggattgattttatatttttaagggtagtttaaagattttgttaaaaattagtatgtatttttattaatattttgaaatatttataattggtggtaagaatagtttttttatatgggatagttaggttaagattagaaataattaagtgtattttttaagatagttttttaaatgtttaaatttatttttaagggaaataagtgggggttgatttatggaaagaggggatagaaggtagggaaagggtgaaggttagagttaagtgaagaattttgtatgtagagtgatattatagaggatttttggttggtgaaaagattagttgggaatatagttaatatatattaattttgttatttatataatttaaaattgattgtatatgtatttttgtattttttttttaaaatattattaataaataataaattattgtttatataagtaatttgtgattttaatatgggtgttaatttatttgtttaggtggtttataaatgttttgttttgtttgtttattaaatttttatatgtattaggtgtttatatgggataatttgatgtttataaagtggattaaatttagtggtaaatgttatttgggtatttgtttatatatggagatatttttaaaggattgtatttgtttgggttataagaaatagaaaaatgtaaaaattaaggtaattttaaaagatagaaaatgtagaatgtttttttatttgtagaatgtattgtttttggatggtttaatgtattaggtttttagtaattaagttaagatgtttttaatttgagagataggattgttagttatttagttagtagttatttttttttaatttttattgtattagatgagtgtaatgaggtgggtttttagttgataattaattaattgagtattgtatggaattggaagagattttggttttggaatttttgggtattttttatggttttagggttaagtggtgttaagagaaggtgggatagaggaatgggaaatgatgtgaggagtgtggaggggtgtgaggttttaagatggtggtagttgaggggttgattgagagatttagttgaaggtttttatgaagtgaaagaggttgggagttgttttttatttgttttttgtagttttgggagtatagtagaagtgtgagtgtattgaattgatttattatttttttttattttttttgttttttttatgttttgtgtagtggtttgggggatatttagtttttttgttttgttttttttttttttggttgaggtttttttgttgtggattgggttatttttgggtttggggtggtgtggtgattagtggttgtgtggttggtattgtttgggttggttggggttgttttttatgtatgttgattagtagttttaggtttgatgttttgtattttgagttatggttggttagttgttgttatggttttgttagttgttggtgttgttttttttggtgaatttggattttattttattgaagtttttttggttgtttagagttatttaatgtttatttggtttgattttttagttgtttttgtttgtagataaaaaattaatttgtagatttaagttttagtgttttttgtaaaattttttgtaatttgtatttgttgtgttttatttgtgggggaggagatttagaatatgagtttgaggaaatttgagaaaggaaagtataaaaaatgtaggtaattaaagatgggagagtttgtatatgtattgattttgtttgtttttttttttttttattttttattttttgttgtttttttatttttttaatttttttatttttagttttttttagaaggaaattatttgatagggtgtatggtagttaggttaggaatatggatttattataaagattttagttaagtagtgagttaaatattataggatattttatttgtaattttattgtattattagagttttgttataaagtaattgatgtttttattttttagatgaggaagttaaaaattagagtttttgatattgttgttttgaagtaattgttattagaatagttgtgaaatatttggttttttgaaatatttggtttttggggtagttggatatttggtgaaagagatattaattgtaataaattgggttgataaaatttttttttttttatttttaaaaagtgtttatttgtaaaaggaagtaaatttgtttgtttttattattggaaagattgtgttttaaaaaattaagttttattattttggaataagaggaagaagttatgtaatagggtattgtgttaataaaagttttagtttataaaatattttttttttaaataaaaataagtattttttttaattattttaagaaatatatattgggagttaggttttagtaagaaaaatatgtgttttaatatttaagttttggggagtttttagtatagtattaattttaaatatttgtatttttagttgtgttttgaatttttgagagttaagtattatatttgaattagaattgaatttgaattaaatatgtttaaattaatgagtttttagtgttttagaagtattgagaatgtatagtatatatgttaagaaaaattatggagagaggtaaaggtgaggtatgtgttttgagtttagatttattatttttattttttttttattttttttttataattatatgttaataaagggaggttatagaagaaggattaatgaattttgatgtttatggtttgtgttatattgttaaagtattttttagttgtttttattagttgataaagttagtgttgtgatttataagaaaaaagttaaattgatgatttgaggatatttaaagtggtttttatatttattatatttttgaagaatgatagagatttaaatttttatggttaagaaaggtgatgttattttttttggatattaaagttaaaattaaggaaagaatagttttatagaatttttaattaaaggaatttttttttagagattggtagggattagaaaaaggaagaaatata

SEQ ID NO: 795 - DNA, 28 bp, Artificial Sequence
  Detection primer for ABCB1
taagtatgttgaagaaagattattgtag

SEQ ID NO: 796 - DNA, 28 bp, Artificial Sequence
  Detection primer for ABCB1
taaaaactatcccataataactcccaac

SEQ ID NO: 797 - DNA, 20 bp, Artificial Sequence
  Detection primer for APOC2
atgagtagaagaggtgatat

SEQ ID NO: 798 - DNA, 20 bp, Artificial Sequence
  Detection primer for APOC2
ccctaaatccctttcttacc

SEQ ID NO: 799 - DNA, 23 bp, Artificial Sequence
  Detection primer for CACNA1G
gggatttaagagaaattgaggta

SEQ ID NO: 800 - DNA, 20 bp, Artificial Sequence
  Detection primer for CACNA1G
aaaccccaaacatcctttat

SEQ ID NO: 801 - DNA, 20 bp, Artificial Sequence
  Detection primer for EGR4
cccaaacataaacacaaaat

SEQ ID NO: 802 - DNA, 20 bp, Artificial Sequence
  Detection primer for EGR4
agggggattgagtgttaagt

SEQ ID NO: 803 - DNA, 20 bp, Artificial Sequence
  Detection primer for AR
gtagtagtagtagtaagaga

SEQ ID NO: 804 - DNA, 20 bp, Artificial Sequence
  Detection primer for AR
accccctaaataattatcct

SEQ ID NO: 805 - DNA, 23 bp, Artificial Sequence
  Detection primer for RB1
tttaagtttgtttttgttttggt

SEQ ID NO: 806 - DNA, 22 bp, Artificial Sequence
  Detection primer for RB1
tcctactctaaatcctcctcaa

SEQ ID NO: 807 - DNA, 22 bp, Artificial Sequence
  Detection primer for GP1BB
ggtgataggagaataatgttgg

SEQ ID NO: 808 - DNA, 20 bp, Artificial Sequence
  Detection primer for GP1BB
tctcccaactacaaccaaac

SEQ ID NO: 809 - DNA, 19 bp, Artificial Sequence
  Detection primer for WT1
taactaccctcaacttccc

SEQ ID NO: 810 - DNA, 20 bp, Artificial Sequence
  Detection primer for WT1
aaagggaaattaagtgttgt

SEQ ID NO: 811 - DNA, 22 bp, Artificial Sequence
  Detection primer for HLA-F
ttgttgtttttaggggttttgg

SEQ ID NO: 812 - DNA, 22 bp, Artificial Sequence
  Detection primer for HLA-F
tccttcccattctccaaatatc

SEQ ID NO: 813 - DNA, 24 bp, Artificial Sequence
  Detection primer for ELK1
aagtgttttagtttttaatgggta

SEQ ID NO: 814 - DNA, 20 bp, Artificial Sequence
  Detection primer for ELK1
caaacccaaaactcacctat

SEQ ID NO: 815 - DNA, 20 bp, Artificial Sequence
  Detection primer for ARHI
gtgagtttttggggtgttta

SEQ ID NO: 816 - DNA, 25 bp, Artificial Sequence
  Detection primer for ARHI
tcaatcttactttcacactacataa

SEQ ID NO: 817 - DNA, 22 bp, Artificial Sequence
  Detection primer for BCL2
gtattttatgttaagggggaaa

SEQ ID NO: 818 - DNA, 18 bp, Artificial Sequence
  Detection primer for BCL2
aaaaaccacaatcctccc

SEQ ID NO: 819 - DNA, 20 bp, Artificial Sequence
  Detection primer for BRCA1
tggatgggaattgtagtttt

SEQ ID NO: 820 - DNA, 19 bp, Artificial Sequence
  Detection primer for BRCA1
ttaaccacccaatctaccc

SEQ ID NO: 821 - DNA, 20 bp, Artificial Sequence
  Detection primer for CALCA
gttttggaagtatgagggtg

SEQ ID NO: 822 - DNA, 21 bp, Artificial Sequence
  Detection primer for CALCA
ccaaattctaaaccaatttcc

SEQ ID NO: 823 - DNA, 21 bp, Artificial Sequence
  Detection primer for CCND2
ttttggtatgtaggttggatg

SEQ ID NO: 824 - DNA, 21 bp, Artificial Sequence
  Detection primer for CCND2
cctaacctccttcctttaact

SEQ ID NO: 825 - DNA, 19 bp, Artificial Sequence
  Detection primer for CDH1
gaggttggggttagaggat

SEQ ID NO: 826 - DNA, 25 bp, Artificial Sequence
  Detection primer for CDH1
caaactcacaaatactttacaattc

SEQ ID NO: 827 - DNA, 19 bp, Artificial Sequence
  Detection primer for CDKN1B
gtggggaggtagttgaaga

SEQ ID NO: 828 - DNA, 20 bp, Artificial Sequence
  Detection primer for CDKN1B
atacacccctaacccaaaat

SEQ ID NO: 829 - DNA, 20 bp, Artificial Sequence
  Detection primer for CDKN2A
ttgaaaattaagggttgagg

SEQ ID NO: 830 - DNA, 20 bp, Artificial Sequence
  Detection primer for CDKN2A
caccctctaataaccaacca

SEQ ID NO: 831 - DNA, 20 bp, Artificial Sequence
  Detection primer for CDKN2A
ggggttggttggttattaga

SEQ ID NO: 832 - DNA, 20 bp, Artificial Sequence
  Detection primer for CDKN2A
aaccctctacccacctaaat

SEQ ID NO: 833 - DNA, 22 bp, Artificial Sequence
  Detection primer for CDKN2B
ggttggttgaaggaatagaaat

SEQ ID NO: 834 - DNA, 22 bp, Artificial Sequence
  Detection primer for CDKN2B
cccactaaacatacccttattc

SEQ ID NO: 835 - DNA, 21 bp, Artificial Sequence
  Detection primer for CD44
gaaaggagaggttaaaggttg

SEQ ID NO: 836 - DNA, 21 bp, Artificial Sequence
  Detection primer for CD44
aactcacttaactccaatccc

SEQ ID NO: 837 - DNA, 22 bp, Artificial Sequence
  Detection primer for CSPG2
ggataggagttgggattaagat

SEQ ID NO: 838 - DNA, 22 bp, Artificial Sequence
  Detection primer for CSPG2
aaatctttttcaacaccaaaat

SEQ ID NO: 839 - DNA, 22 bp, Artificial Sequence
  Detection primer for DAPK1
aaccctttcttcaaattacaaa

SEQ ID NO: 840 - DNA, 21 bp, Artificial Sequence
  Detection primer for DAPK1
tgattgggttttagggaaata

SEQ ID NO: 841 - DNA, 21 bp, Artificial Sequence
  Detection primer for GGT1
gtgaagggtgtgagttgttta

SEQ ID NO: 842 - DNA, 19 bp, Artificial Sequence
  Detection primer for GGT1
cacaatcaatttcccacaa

SEQ ID NO: 843 - DNA, 19 bp, Artificial Sequence
  Detection primer for GSTP1
atttgggaaagagggaaag

SEQ ID NO: 844 - DNA, 21 bp, Artificial Sequence
  Detection primer for GSTP1
taaaaactctaaaccccatcc

SEQ ID NO: 845 - DNA, 20 bp, Artificial Sequence
  Detection primer for HIC1
tgggttggagaagaagttta

SEQ ID NO: 846 - DNA, 21 bp, Artificial Sequence
  Detection primer for HIC1
tcatatttccaaaaacacacc

SEQ ID NO: 847 - DNA, 25 bp, Artificial Sequence
  Detection primer for STMN1
gagtttgtatttaagttgagtggtt

SEQ ID NO: 848 - DNA, 22 bp, Artificial Sequence
  Detection primer for STMN1
aacaaaacaataccccttctaa

SEQ ID NO: 849 - DNA, 21 bp, Artificial Sequence
  Detection primer for STK11
catcttatttacctccctccc

SEQ ID NO: 850 - DNA, 22 bp, Artificial Sequence
  Detection primer for STK11
taaaagaaggatttttgattgg

SEQ ID NO: 851 - DNA, 22 bp, Artificial Sequence
  Detection primer for ING4
attagggatgagaggatttgta

SEQ ID NO: 852 - DNA, 24 bp, Artificial Sequence
  Detection primer for ING4
tcttcctaaccatacacactaacc

SEQ ID NO: 853 - DNA, 22 bp, Artificial Sequence
  Detection primer for MGMT
aaggttttagggaagagtgttt

SEQ ID NO: 854 - DNA, 23 bp, Artificial Sequence
  Detection primer for MGMT
accttttcctatcacaaaaataa

SEQ ID NO: 855 - DNA, 20 bp, Artificial Sequence
  Detection primer for MLH1
taaggggagaggaggagttt

SEQ ID NO: 856 - DNA, 22 bp, Artificial Sequence
  Detection primer for MLH1
accaattctcaatcatctcttt

SEQ ID NO: 857 - DNA, 22 bp, Artificial Sequence
  Detection primer for MYC
agagggagtaaaagaaaatggt

SEQ ID NO: 858 - DNA, 22 bp, Artificial Sequence
  Detection primer for MYC
ccaaataaacaaaataacctcc

SEQ ID NO: 859 - DNA, 22 bp, Artificial Sequence
  Detection primer for N33
ttttagattgaggttttagggt

SEQ ID NO: 860 - DNA, 22 bp, Artificial Sequence
  Detection primer for N33
atccattctacctcctttttct

SEQ ID NO: 861 - DNA, 18 bp, Artificial Sequence
  Detection primer for PAX6
ggaggggagagggttatg

SEQ ID NO: 862 - DNA, 22 bp, Artificial Sequence
  Detection primer for PAX6
tactatacacaccccaaaacaa

SEQ ID NO: 863 - DNA, 19 bp, Artificial Sequence
  Detection primer for X51730 PGR
ttttgggaatgggttgtat

SEQ ID NO: 864 - DNA, 21 bp, Artificial Sequence
  Detection primer for X51730 PGR
ctacccttaacctccatccta

SEQ ID NO: 865 - DNA, 26 bp, Artificial Sequence
  Detection primer for PTEN
ttttaggtagttatattgggtatgtt

SEQ ID NO: 866 - DNA, 21 bp, Artificial Sequence
  Detection primer for PTEN
tcaactctcaaacttccatca

SEQ ID NO: 867 - DNA, 22 bp, Artificial Sequence
  Detection primer for RARB
ttgttgggagtttttaagtttt

SEQ ID NO: 868 - DNA, 22 bp, Artificial Sequence
  Detection primer for RARB
caaattctccttccaaataaat

SEQ ID NO: 869 - DNA, 19 bp, Artificial Sequence
  Detection primer for SFN
ctatccaacaaacccaaca

SEQ ID NO: 870 - DNA, 20 bp, Artificial Sequence
  Detection primer for SFN
gaagagaggagagggaggta

SEQ ID NO: 871 - DNA, 22 bp, Artificial Sequence
  Detection primer for S100A2
gtttttaagttggagaagagga

SEQ ID NO: 872 - DNA, 22 bp, Artificial Sequence
  Detection primer for S100A2
acctataaatcacaacccactc

SEQ ID NO: 873 - DNA, 22 bp, Artificial Sequence
  Detection primer for TGFBR2
gtaatttgaagaaagttgaggg

SEQ ID NO: 874 - DNA, 22 bp, Artificial Sequence
  Detection primer for TGFBR2
ccaacaactaaacaaaacctct

SEQ ID NO: 875 - DNA, 22 bp, Artificial Sequence
  Detection primer for TIMP3
tgagaaaattgttgtttgaagt

SEQ ID NO: 876 - DNA, 22 bp, Artificial Sequence
  Detection primer for TIMP3
caaaataccctaaaaaccactc

SEQ ID NO: 877 - DNA, 26 bp, Artificial Sequence
  Detection primer for VHL
tgtaaaatgaataaagttaatgagtg

SEQ ID NO: 878 - DNA, 23 bp, Artificial Sequence
  Detection primer for VHL
tcctaaattcaaataatcctcct

SEQ ID NO: 879 - DNA, 22 bp, Artificial Sequence
  Detection primer for CDKN1C
ggggaggtagatatttggataa

SEQ ID NO: 880 - DNA, 23 bp, Artificial Sequence
  Detection primer for CDKN1C
aactacaccatttatattcccac

SEQ ID NO: 881 - DNA, 22 bp, Artificial Sequence
  Detection primer for CAV1
ataaataacaccttccacccta

SEQ ID NO: 882 - DNA, 22 bp, Artificial Sequence
  Detection primer for CAV1
gttagtatgtttgggggtaaat

SEQ ID NO: 883 - DNA, 22 bp, Artificial Sequence
  Detection primer for CDH13
tttgtattaggttggaagtggt

SEQ ID NO: 884 - DNA, 22 bp, Artificial Sequence
  Detection primer for CDH13
cccaaataaatcaacaacaaca

SEQ ID NO: 885 - DNA, 22 bp, Artificial Sequence
  Detection primer for NDRG1
aactttcataactcaccctttc

SEQ ID NO: 886 - DNA, 22 bp, Artificial Sequence
  Detection primer for NDRG1
ggttttgggtttagtggtaaat

SEQ ID NO: 887 - DNA, 22 bp, Artificial Sequence
  Detection primer for PTGS2
aaaactaaaaaccaaacccata

SEQ ID NO: 888 - DNA, 22 bp, Artificial Sequence
  Detection primer for PTGS2
gatttttggagaggaagttaag

SEQ ID NO: 889 - DNA, 20 bp, Artificial Sequence
  Detection primer for THBS1
tggggttagtttaggatagg

SEQ ID NO: 890 - DNA, 25 bp, Artificial Sequence
  Detection primer for THBS1
cttaaaaacactaaaacttctcaaa

SEQ ID NO: 891 - DNA, 21 bp, Artificial Sequence
  Detection primer for TMEFF2
ttgtttgggttaataaatgga

SEQ ID NO: 892 - DNA, 20 bp, Artificial Sequence
  Detection primer for TMEFF2
cttctctcttctcccctctc

SEQ ID NO: 893 - DNA, 22 bp, Artificial Sequence
  Detection primer for PLAU
tattataggaggattgaggagg

SEQ ID NO: 894 - DNA, 22 bp, Artificial Sequence
  Detection primer for PLAU
cccataaaatcataccacttct

SEQ ID NO: 895 - DNA, 20 bp, Artificial Sequence
  Detection primer for TMEFF2
tgttggttgttgttgttgtt

SEQ ID NO: 896 - DNA, 19 bp, Artificial Sequence
  Detection primer for TMEFF2
ctttctacccatcccaaaa

SEQ ID NO: 897 - DNA, 18 bp, Artificial Sequence
  Detection primer for DNMT1
tccccatcacacctaaaa

SEQ ID NO: 898 - DNA, 18 bp, Artificial Sequence
  Detection primer for DNMT1
gggaggaggggatgtatt

SEQ ID NO: 899 - DNA, 22 bp, Artificial Sequence
  Detection primer for ESR1
agggggaattaaatagaaagag

SEQ ID NO: 900 - DNA, 22 bp, Artificial Sequence
  Detection primer for ESR1
caataaaaccatcccaaatact

SEQ ID NO: 901 - DNA, 23 bp, Artificial Sequence
  Detection primer for APAF1
agatatgtttggagattttagga

SEQ ID NO: 902 - DNA, 22 bp, Artificial Sequence
  Detection primer for APAF1
aactccccacctctaattctat

SEQ ID NO: 903 - DNA, 23 bp, Artificial Sequence
  Detection primer for HOXA5
gaagggggaaagttatttagtta

SEQ ID NO: 904 - DNA, 20 bp, Artificial Sequence
  Detection primer for HOXA5
aaaccccaaacaacctctat

SEQ ID NO: 905 - DNA, 24 bp, Artificial Sequence
  Detection primer for RASSF1
acctctctacaaattacaaattca

SEQ ID NO: 906 - DNA, 20 bp, Artificial Sequence
  Detection primer for RASSF1
agtttgggttagtttgggtt

SEQ ID NO: 907 - DNA, 22 bp, Artificial Sequence
  Detection primer for BRCA2
ggttggtagagataaaagggta

SEQ ID NO: 908 - DNA, 18 bp, Artificial Sequence
  Detection primer for BRCA2
acccacccaaacctaact

SEQ ID NO: 909 - DNA, 22 bp, Artificial Sequence
  Detection primer for CCND1
gattataggggagttttgttga

SEQ ID NO: 910 - DNA, 19 bp, Artificial Sequence
  Detection primer for CCND1
cacctccaacatccaaata

SEQ ID NO: 911 - DNA, 22 bp, Artificial Sequence
  Detection primer for EDNRB
ataattgggggttgtatgtatt

SEQ ID NO: 912 - DNA, 22 bp, Artificial Sequence
  Detection primer for EDNRB
tcaaaacatcctctatctctcc

SEQ ID NO: 913 - DNA, 22 bp, Artificial Sequence
  Detection primer for EGFR
gggtttggttgtaatatggatt

SEQ ID NO: 914 - DNA, 19 bp, Artificial Sequence
  Detection primer for EGFR
cccaacactacccctctaa

SEQ ID NO: 915 - DNA, 21 bp, Artificial Sequence
  Detection primer for ERBB2
gaggtagaggttgtggtgagt

SEQ ID NO: 916 - DNA, 19 bp, Artificial Sequence
  Detection primer for ERBB2
tcccaacttcactttctcc

SEQ ID NO: 917 - DNA, 22 bp, Artificial Sequence
  Detection primer for FOS
ttttagggttatagggaaaggt

SEQ ID NO: 918 - DNA, 21 bp, Artificial Sequence
  Detection primer for FOS
atcctccactttctacttcca

SEQ ID NO: 919 - DNA, 25 bp, Artificial Sequence
  Detection primer for NFKB1
tttgtagaatgaaaagtagagtgtg

SEQ ID NO: 920 - DNA, 20 bp, Artificial Sequence
  Detection primer for NFKB1
accttaaaaaccccaacaat

SEQ ID NO: 921 - DNA, 19 bp, Artificial Sequence
  Detection primer for X51730 PGR
ttttgggaatgggttgtat

SEQ ID NO: 922 - DNA, 21 bp, Artificial Sequence
  Detection primer for X51730 PGR
ctacccttaacctccatccta

SEQ ID NO: 923 - DNA, 22 bp, Artificial Sequence
  Detection primer for TP53
gagtaggtagttgttgggtttc

SEQ ID NO: 924 - DNA, 22 bp, Artificial Sequence
  Detection primer for TP53
acccctaatttaacacttctca

SEQ ID NO: 925 - DNA, 24 bp, Artificial Sequence
  Detection primer for TP73
agtaaatagtgggtgagttatgaa

SEQ ID NO: 926 - DNA, 25 bp, Artificial Sequence
  Detection primer for TP73
gaaaaacctctaaaaactactctcc

SEQ ID NO: 927 - DNA, 22 bp, Artificial Sequence
  Detection primer for ESR1
agggggaattaaatagaaagag

SEQ ID NO: 928 - DNA, 22 bp, Artificial Sequence
  Detection primer for ESR1
caataaaaccatcccaaatact

SEQ ID NO: 929 - DNA, 22 bp, Artificial Sequence
  Detection primer for SERPINE1
ggggtatagagagagtttggat

SEQ ID NO: 930 - DNA, 22 bp, Artificial Sequence
  Detection primer for SERPINE1
acaattaaacaaaccccaataa

SEQ ID NO: 931 - DNA, 22 bp, Artificial Sequence
  Detection primer for CALM1
tatttttagtttggggtgttgt

SEQ ID NO: 932 - DNA, 22 bp, Artificial Sequence
  Detection primer for CALM1
aaaaactctaacccttctcaaa

SEQ ID NO: 933 - DNA, 22 bp, Artificial Sequence
  Detection primer for CSNK2B
tagttttgtgtttattgggtga

SEQ ID NO: 934 - DNA, 22 bp, Artificial Sequence
  Detection primer for CSNK2B
tacccctcaccattactctaac

SEQ ID NO: 935 - DNA, 21 bp, Artificial Sequence
  Detection primer for FGFR1
agggagttagtggtgtggtat

SEQ ID NO: 936 - DNA, 22 bp, Artificial Sequence
  Detection primer for FGFR1
cctttacccttctcaaatctaa

SEQ ID NO: 937 - DNA, 21 bp, Artificial Sequence
  Detection primer for MKI67
gggaagttgaagtaggaagat

SEQ ID NO: 938 - DNA, 22 bp, Artificial Sequence
  Detection primer for MKI67
ccaatactctacaaccatcaaa

SEQ ID NO: 939 - DNA, 22 bp, Artificial Sequence
  Detection primer for NPM1
aaggaaggaggaagtaatttgt

SEQ ID NO: 940 - DNA, 22 bp, Artificial Sequence
  Detection primer for NPM1
ttacaccaacccctaaactaac

SEQ ID NO: 941 - DNA, 22 bp, Artificial Sequence
  Detection primer for MAPK1
tttagataattttaggatgggg

SEQ ID NO: 942 - DNA, 22 bp, Artificial Sequence
  Detection primer for MAPK1
ttctcattcacaaaaacaaaaa

SEQ ID NO: 943 - DNA, 22 bp, Artificial Sequence
  Detection primer for SYK
gtgggttttgggtagttataga

SEQ ID NO: 944 - DNA, 20 bp, Artificial Sequence
  Detection primer for SYK
taacctcctctccttaccaa

SEQ ID NO: 945 - DNA, 22 bp, Artificial Sequence
  Detection primer for TK2
agggagaaggaagttatttgtt

SEQ ID NO: 946 - DNA, 22 bp, Artificial Sequence
  Detection primer for TK2
atacaacctcaaatcctatcca

SEQ ID NO: 947 - DNA, 23 bp, Artificial Sequence
  Detection primer for HSPB1
aagagggtttagtttttatttgg

SEQ ID NO: 948 - DNA, 22 bp, Artificial Sequence
  Detection primer for HSPB1
cctacctctaccacttctcaat

SEQ ID NO: 949 - DNA, 21 bp, Artificial Sequence
  Detection primer for TES
aggttggggattttagttttt

SEQ ID NO: 950 - DNA, 22 bp, Artificial Sequence
  Detection primer for TES
accttcttcactttattttcca

SEQ ID NO: 951 - DNA, 22 bp, Artificial Sequence
  Detection primer for SDC4
agttggggaaattaaggtttag

SEQ ID NO: 952 - DNA, 21 bp, Artificial Sequence
  Detection primer for SDC4
cctaactaccctcattccttt

SEQ ID NO: 953 - DNA, 21 bp, Artificial Sequence
  Detection primer for PITX2
gtaggggagggaagtagatgt

SEQ ID NO: 954 - DNA, 23 bp, Artificial Sequence
  Detection primer for PITX2
tcctcaactctacaaacctaaaa

SEQ ID NO: 955 - DNA, 22 bp, Artificial Sequence
  Detection primer for GPR37
tatggtttggtgagggtatatt

SEQ ID NO: 956 - DNA, 26 bp, Artificial Sequence
  Detection primer for GPR37
acttatttttcttttcctctaaaaac

SEQ ID NO: 957 - DNA, 22 bp, Artificial Sequence
  Detection primer for FGF1
agttgtgtttaattgggaagag

SEQ ID NO: 958 - DNA, 22 bp, Artificial Sequence
  Detection primer for FGF1
cttatcccatccactataccat

SEQ ID NO: 959 - DNA, 22 bp, Artificial Sequence
  Detection primer for GRIN2D
atagtttgtggtttggattttt

SEQ ID NO: 960 - DNA, 22 bp, Artificial Sequence
  Detection primer for GRIN2D
aaaacctttccctaacttcaat

SEQ ID NO: 961 - DNA, 23 bp, Artificial Sequence
  Detection primer for CTSB
aaaaaggaaggtagtaggattgt

SEQ ID NO: 962 - DNA, 23 bp, Artificial Sequence
  Detection primer for CTSB
aaaattccatcaaataaccataa

SEQ ID NO: 963 - DNA, 20 bp, Artificial Sequence
  Detection primer for CTSD
aaggggtttttaaggaaatg

SEQ ID NO: 964 - DNA, 22 bp, Artificial Sequence
  Detection primer for CTSD
atacaaccctccaaccttctac

SEQ ID NO: 965 - DNA, 22 bp, Artificial Sequence
  Detection primer for PLAUR
tggttaaaatggagggtttaat

SEQ ID NO: 966 - DNA, 22 bp, Artificial Sequence
  Detection primer for PLAUR
ccccaaattacctaaatacaaa

SEQ ID NO: 967 - DNA, 22 bp, Artificial Sequence
  Detection primer for PSA
taagagagaggagttgaggttt

SEQ ID NO: 968 - DNA, 22 bp, Artificial Sequence
  Detection primer for PSA
ccaaaattaaccacctacctaa

SEQ ID NO: 969 - DNA, 24 bp, Artificial Sequence
  Detection primer for CGA
tagtggtataagtttggaaatgtt

SEQ ID NO: 970 - DNA, 22 bp, Artificial Sequence
  Detection primer for CGA
tccacctacatctaaaccctaa

SEQ ID NO: 971 - DNA, 22 bp, Artificial Sequence
  Detection primer for CYP2D6
taagggtttggagtaggaagta

SEQ ID NO: 972 - DNA, 22 bp, Artificial Sequence
  Detection primer for CYP2D6
cacatacaacaaaattacccaa

SEQ ID NO: 973 - DNA, 22 bp, Artificial Sequence
  Detection primer for CYP3A4
gtttgatgaatggattgtatga

SEQ ID NO: 974 - DNA, 22 bp, Artificial Sequence
  Detection primer for CYP3A4
tatcaccaccttcccatattta

SEQ ID NO: 975 - DNA, 22 bp, Artificial Sequence
  Detection primer for TK1
ttgggggagttaggtagtatag

SEQ ID NO: 976 - DNA, 23 bp, Artificial Sequence
  Detection primer for TK1
acctctacaaacatcttattcca

SEQ ID NO: 977 - DNA, 22 bp, Artificial Sequence
  Detection primer for RENBP
tttggtagggttaaggttttta

SEQ ID NO: 978 - DNA, 21 bp, Artificial Sequence
  Detection primer for RENBP
cttactcatccctcctactcc

SEQ ID NO: 979 - DNA, 22 bp, Artificial Sequence
  Detection primer for F12
taggtttaggagggtagtttga

SEQ ID NO: 980 - DNA, 21 bp, Artificial Sequence
  Detection primer for F12
ctctcacaacccaaaaataca

SEQ ID NO: 981 - DNA, 22 bp, Artificial Sequence
  Detection primer for REN
tatgtggaaaagttagggtgtt

SEQ ID NO: 982 - DNA, 22 bp, Artificial Sequence
  Detection primer for REN
acctactccaaaaatcacaaaa

SEQ ID NO: 983 - DNA, 22 bp, Artificial Sequence
  Detection primer for EBAG9
aatgttttagaggttagggttg

SEQ ID NO: 984 - DNA, 20 bp, Artificial Sequence
  Detection primer for EBAG9
ccaaaactcattaactccca

SEQ ID NO: 985 - DNA, 22 bp, Artificial Sequence
  Detection primer for MSMB
gttttgtaggatggtttgattt

SEQ ID NO: 986 - DNA, 22 bp, Artificial Sequence
  Detection primer for MSMB
tatatttaccttatccccaccc

SEQ ID NO: 987 - DNA, 22 bp, Artificial Sequence
  Detection primer for X15323 angiotensinogen gene 5'region and exon 1
gatggagttgtttttaggttgt

SEQ ID NO: 988 - DNA, 21 bp, Artificial Sequence
  Detection primer for X15323 angiotensinogen gene 5'region and exon 1
aaactctcccctaccctctac

SEQ ID NO: 989 - DNA, 22 bp, Artificial Sequence
  Detection primer for ZNF147
tttgtgtaaataagatgtggga

SEQ ID NO: 990 - DNA, 22 bp, Artificial Sequence
  Detection primer for ZNF147
taaacccctacaaaactaccaa

SEQ ID NO: 991 - DNA, 21 bp, Artificial Sequence
  Detection primer for EBBP
gtatttgtttttggtgagggt

SEQ ID NO: 992 - DNA, 22 bp, Artificial Sequence
  Detection primer for EBBP
atcatcttcctaaacattccaa

SEQ ID NO: 993 - DNA, 21 bp, Artificial Sequence
  Detection primer for CALR
ataagaggggaggaaggttta

SEQ ID NO: 994 - DNA, 22 bp, Artificial Sequence
  Detection primer for CALR
taaatcacaaccattaaccaaa

SEQ ID NO: 995 - DNA, 21 bp, Artificial Sequence
  Detection primer for BCAR1
tttatttttgggaaggttgtt

SEQ ID NO: 996 - DNA, 22 bp, Artificial Sequence
  Detection primer for BCAR1
aattcttccttctatctccctc

SEQ ID NO: 997 - DNA, 22 bp, Artificial Sequence
  Detection primer for COX7A2L
ggaggtgtaaggagaatagaga

SEQ ID NO: 998 - DNA, 25 bp, Artificial Sequence
  Detection primer for COX7A2L
aatcctaaaaaccctaacttttaat

SEQ ID NO: 999 - DNA, 21 bp, Artificial Sequence
  Detection primer for AF174646 glandular kallikrein gene, promoter region and partial sequence
atttatttgggaggatagtgg

SEQ ID NO: 1000 - DNA, 22 bp, Artificial Sequence
  Detection primer for AF174646 glandular kallikrein gene, promoter region and partial sequence
ccaattcatcattcaacatcta

SEQ ID NO: 1001 - DNA, 22 bp, Artificial Sequence
  Detection primer for KLK3
ttggagtgtaaaggatttaggt

SEQ ID NO: 1002 - DNA, 23 bp, Artificial Sequence
  Detection primer for KLK3
aacccacataataacacaactct

SEQ ID NO: 1003 - DNA, 23 bp, Artificial Sequence
  Detection primer for AKR1B1
aggtatttaattttaggatgggt

SEQ ID NO: 1004 - DNA, 24 bp, Artificial Sequence
  Detection primer for AKR1B1
caacaaaaacattcttctaaactc

SEQ ID NO: 1005 - DNA, 22 bp, Artificial Sequence
  Detection primer for TGM4
gagagggtaatggttttaggta

SEQ ID NO: 1006 - DNA, 22 bp, Artificial Sequence
  Detection primer for TGM4
aatcctaacttttaatcaccca

SEQ ID NO: 1007 - DNA, 22 bp, Artificial Sequence
  Detection primer for AR
aatatagggaggtttagggttt

SEQ ID NO: 1008 - DNA, 22 bp, Artificial Sequence
  Detection primer for AR
taaccatacatttctcatccaa

SEQ ID NO: 1009 - DNA, 20 bp, Artificial Sequence
  Detection primer for HSPA1A
ggatttattggaggggatag

SEQ ID NO: 1010 - DNA, 21 bp, Artificial Sequence
  Detection primer for HSPA1A
aacctttcaaattcacaatca

SEQ ID NO: 1011 - DNA, 21 bp, Artificial Sequence
  Detection primer for FKBP4
tttttaagtagggaagggttt

SEQ ID NO: 1012 - DNA, 21 bp, Artificial Sequence
  Detection primer for FKBP4
tccttctaactacctaccccc

SEQ ID NO: 1013 - DNA, 22 bp, Artificial Sequence
  Detection primer for ESR2
tagaggggagtagtgtttgagt

SEQ ID NO: 1014 - DNA, 22 bp, Artificial Sequence
  Detection primer for ESR2
aaaccttcccaataacctctta

SEQ ID NO: 1015 - DNA, 22 bp, Artificial Sequence
  Detection primer for IGF1
gtattaaaggaatatgggggat

SEQ ID NO: 1016 - DNA, 22 bp, Artificial Sequence
  Detection primer for IGF1
tacccttctcccaaaataataa

SEQ ID NO: 1017 - DNA, 22 bp, Artificial Sequence
  Detection primer for VTN
gttatttgggttaatgtaggga

SEQ ID NO: 1018 - DNA, 22 bp, Artificial Sequence
  Detection primer for VTN
tctatcccctcaaacttaaaaa

SEQ ID NO: 1019 - DNA, 22 bp, Artificial Sequence
  Detection primer for CTSL
ttagtggatttggaggaagtag

SEQ ID NO: 1020 - DNA, 22 bp, Artificial Sequence
  Detection primer for CTSL
ctacacccacccttaaataaaa

SEQ ID NO: 1021 - DNA, 22 bp, Artificial Sequence
  Detection primer for TGFB3
aaggtggtgtaagtggatagag

SEQ ID NO: 1022 - DNA, 22 bp, Artificial Sequence
  Detection primer for TGFB3
cctactaaaaatcaaaacccaa

SEQ ID NO: 1023 - DNA, 22 bp, Artificial Sequence
  Detection primer for MAPKAPK5
atttttggttttagggttgtaa

SEQ ID NO: 1024 - DNA, 20 bp, Artificial Sequence
  Detection primer for MAPKAPK5
aaacctacctccccaactaa

SEQ ID NO: 1025 - DNA, 22 bp, Artificial Sequence
  Detection primer for PCAF
ggataaatgattgagaggttgt

SEQ ID NO: 1026 - DNA, 20 bp, Artificial Sequence
  Detection primer for PCAF
cctcccttaattctcctacc

SEQ ID NO: 1027 - DNA, 20 bp, Artificial Sequence
  Detection primer for NCOA3
aagggggtgtttgttagatt

SEQ ID NO: 1028 - DNA, 22 bp, Artificial Sequence
  Detection primer for NCOA3
cctaaccctacccttaattttt

SEQ ID NO: 1029 - DNA, 27 bp, Artificial Sequence
  Detection primer for PRKCD
gatagaaggattttagtttttattgtt

SEQ ID NO: 1030 - DNA, 18 bp, Artificial Sequence
  Detection primer for PRKCD
cttaacccatcccaatca

SEQ ID NO: 1031 - DNA, 22 bp, Artificial Sequence
  Detection primer for S100A2
gtttttaagttggagaagagga

SEQ ID NO: 1032 - DNA, 22 bp, Artificial Sequence
  Detection primer for S100A2
acctataaatcacaacccactc

SEQ ID NO: 1033 - DNA, 22 bp, Artificial Sequence
  Detection primer for TFF1
ttggtgatgttgattagagttt

SEQ ID NO: 1034 - DNA, 22 bp, Artificial Sequence
  Detection primer for TFF1
taaaacaccttacattttccct

SEQ ID NO: 1035 - DNA, 21 bp, Artificial Sequence
  Detection primer for PSA
gtaggtggttaattttgggtt

SEQ ID NO: 1036 - DNA, 23 bp, Artificial Sequence
  Detection primer for PSA
ctcattcacactatatccattca

SEQ ID NO: 1037 - DNA, 22 bp, Artificial Sequence
  Detection primer for ESR1
ttgttggatagaggttgagttt

SEQ ID NO: 1038 - DNA, 21 bp, Artificial Sequence
  Detection primer for ESR1
ctatcaattcccccaactact

SEQ ID NO: 1039 - DNA, 20 bp, Artificial Sequence
  Detection primer for TMEFF2
tgttggttgttgttgttgtt

SEQ ID NO: 1040 - DNA, 19 bp, Artificial Sequence
  Detection primer for TMEFF2
ctttctacccatcccaaaa

SEQ ID NO: 1041 - DNA, 23 bp, Artificial Sequence
  Detection primer for TP53
ttgatgagaagaaaggatttagt

SEQ ID NO: 1042 - DNA, 23 bp, Artificial Sequence
  Detection primer for TP53
tcaaattcaatcaaaaacttacc

SEQ ID NO: 1043 - DNA, 22 bp, Artificial Sequence
  Detection primer for SYK
gtgggttttgggtagttataga

SEQ ID NO: 1044 - DNA, 20 bp, Artificial Sequence
  Detection primer for SYK
taacctcctctccttaccaa

SEQ ID NO: 1045 - DNA, 23 bp, Artificial Sequence
  Detection primer for DAG1
tttggttatgtggagtttattgt

SEQ ID NO: 1046 - DNA, 22 bp, Artificial Sequence
  Detection primer for DAG1
aataccaacccaaacatctacc

SEQ ID NO: 1047 - DNA, 21 bp, Artificial Sequence
  Detection primer for ONECUT2
tttgttgggatttgttaggat

SEQ ID NO: 1048 - DNA, 22 bp, Artificial Sequence
  Detection primer for ONECUT2
aaacattttacccctctaaacc

SEQ ID NO: 1049 - DNA, 24 bp, Artificial Sequence
  Detection primer for CGA
tagtggtataagtttggaaatgtt

SEQ ID NO: 1050 - DNA, 22 bp, Artificial Sequence
  Detection primer for CGA
tccacctacatctaaaccctaa

SEQ ID NO: 1051 - DNA, 21 bp, Artificial Sequence
  Detection primer for CYP2D6
atttgtagtttggggtgattt

SEQ ID NO: 1052 - DNA, 22 bp, Artificial Sequence
  Detection primer for CYP2D6
aatttcctaacccactatcctc

SEQ ID NO: 1053 - DNA, 22 bp, Artificial Sequence
  Detection primer for RASSF1
agtgggtaggttaagtgtgttg

SEQ ID NO: 1054 - DNA, 19 bp, Artificial Sequence
  Detection primer for RASSF1
ccccaaaatccaaactaaa

SEQ ID NO: 1055 - DNA, 22 bp, Artificial Sequence
  Detection primer for ERBB2
ggagggggtagagttattagtt

SEQ ID NO: 1056 - DNA, 22 bp, Artificial Sequence
  Detection primer for ERBB2
tatacttcctcaaacaaccctc

SEQ ID NO: 1057 - DNA, 21 bp, Artificial Sequence
  Detection primer for PITX2
gtaggggagggaagtagatgt

SEQ ID NO: 1058 - DNA, 23 bp, Artificial Sequence
  Detection primer for PITX2
tcctcaactctacaaacctaaaa

SEQ ID NO: 1059 - DNA, 22 bp, Artificial Sequence
  Detection primer for PCAF
ggataaatgattgagaggttgt

SEQ ID NO: 1060 - DNA, 20 bp, Artificial Sequence
  Detection primer for PCAF
cctcccttaattctcctacc

SEQ ID NO: 1061 - DNA, 24 bp, Artificial Sequence
  Detection primer for WBP11
aagaggtgaggaagagtagtaaat

SEQ ID NO: 1062 - DNA, 22 bp, Artificial Sequence
  Detection primer for WBP11
ctcccaacaactaaatcaaaat

SEQ ID NO: 1063 - DNA, 18 bp, Artificial Sequence
  Detection oligonucleotide for ELK1
gtttacgcggagtttagt

SEQ ID NO: 1064 - DNA, 18 bp, Artificial Sequence
  Detection oligonucleotide for ELK1
gtttatgtggagtttagt

SEQ ID NO: 1065 - DNA, 18 bp, Artificial Sequence
  Detection oligonucleotide for ELK1
gtagtatggcgtgcgata

SEQ ID NO: 1066 - DNA, 18 bp, Artificial Sequence
  Detection oligonucleotide for ELK1
gtagtatggtgtgtgata

SEQ ID NO: 1067 - DNA, 18 bp, Artificial Sequence
  Detection oligonucleotide for ELK1
ttaatcggcgtggagtat

SEQ ID NO: 1068 - DNA, 18 bp, Artificial Sequence
  Detection oligonucleotide for ELK1
ttaattggtgtggagtat

SEQ ID NO: 1069 - DNA, 18 bp, Artificial Sequence
  Detection oligonucleotide for GP1BB
tttgagagcgggtgggag

SEQ ID NO: 1070 - DNA, 18 bp, Artificial Sequence
  Detection oligonucleotide for GP1BB
tttgagagtgggtgggag

SEQ ID NO: 1071 - DNA, 18 bp, Artificial Sequence
  Detection oligonucleotide for GP1BB
ttggttaggtcgtagtat

SEQ ID NO: 1072 - DNA, 18 bp, Artificial Sequence
  Detection oligonucleotide for GP1BB
ttggttaggttgtagtat

SEQ ID NO: 1073 - DNA, 18 bp, Artificial Sequence
  Detection oligonucleotide for GP1BB
gtgggagcggaagtttga

SEQ ID NO: 1074 - DNA, 18 bp, Artificial Sequence
  Detection oligonucleotide for GP1BB
gtgggagtggaagtttga

SEQ ID NO: 1075 - DNA, 18 bp, Artificial Sequence
  Detection oligonucleotide for GP1BB
tgttggtgaacgtcgtag

SEQ ID NO: 1076 - DNA, 18 bp, Artificial Sequence
  Detection oligonucleotide for GP1BB
tgttggtgaatgttgtag

SEQ ID NO: 1077 - DNA, 18 bp, Artificial Sequence
  Detection oligonucleotide for GP1BB
ggagttcggtcgggtttt

SEQ ID NO: 1078 - DNA, 18 bp, Artificial Sequence
  Detection oligonucleotide for GP1BB
ggagtttggttgggtttt

SEQ ID NO: 1079 - DNA, 18 bp, Artificial Sequence
  Detection oligonucleotide for GP1BB
taggtcgattcgggttga

SEQ ID NO: 1080 - DNA, 18 bp, Artificial Sequence
  Detection oligonucleotide for GP1BB
taggttgatttgggttga

SEQ ID NO: 1081 - DNA, 18 bp, Artificial Sequence
  Detection oligonucleotide for WT1
tagtgagacgaggttttt

SEQ ID NO: 1082 - DNA, 18 bp, Artificial Sequence
  Detection oligonucleotide for WT1
tagtgagatgaggttttt

SEQ ID NO: 1083 - DNA, 18 bp, Artificial Sequence
  Detection oligonucleotide for WT1
attgagggacgttcgttt

SEQ ID NO: 1084 - DNA, 18 bp, Artificial Sequence
  Detection oligonucleotide for WT1
attgagggatgtttgttt

SEQ ID NO: 1085 - DNA, 19 bp, Artificial Sequence
  Detection oligonucleotide for WT1
gtattcgattttgttcgga

SEQ ID NO: 1086 - DNA, 19 bp, Artificial Sequence
  Detection oligonucleotide for WT1
gtatttgattttgtttgga

SEQ ID NO: 1087 - DNA, 18 bp, Artificial Sequence
  Detection oligonucleotide for WT1
gtaggcggtaatcgtttt

SEQ ID NO: 1088 - DNA, 18 bp, Artificial Sequence
  Detection oligonucleotide for WT1
gtaggtggtaattgtttt

SEQ ID NO: 1089 - DNA, 19 bp, Artificial Sequence
  Detection oligonucleotide for APC
gggtttcgtttaatcgtat

SEQ ID NO: 1090 - DNA, 19 bp, Artificial Sequence
  Detection oligonucleotide for APC
gggttttgtttaattgtat

SEQ ID NO: 1091 - DNA, 19 bp, Artificial Sequence
  Detection oligonucleotide for APC
ggttcgtatttagcggatt

SEQ ID NO: 1092 - DNA, 19 bp, Artificial Sequence
  Detection oligonucleotide for APC
ggtttgtatttagtggatt

SEQ ID NO: 1093 - DNA, 18 bp, Artificial Sequence
  Detection oligonucleotide for APC
tagttaatcggcgggttt

SEQ ID NO: 1094 - DNA, 18 bp, Artificial Sequence
  Detection oligonucleotide for APC
tagttaattggtgggttt

SEQ ID NO: 1095 - DNA, 19 bp, Artificial Sequence
  Detection oligonucleotide for APC
ttttcgagttcggtagtat

SEQ ID NO: 1096 - DNA, 19 bp, Artificial Sequence
  Detection oligonucleotide for APC
tttttgagtttggtagtat

SEQ ID NO: 1097 - DNA, 19 bp, Artificial Sequence
  Detection oligonucleotide for ARHI
ttttcgagtagcgtatttg

SEQ ID NO: 1098 - DNA, 19 bp, Artificial Sequence
  Detection oligonucleotide for ARHI
tttttgagtagtgtatttg

SEQ ID NO: 1099 - DNA, 18 bp, Artificial Sequence
  Detection oligonucleotide for ARHI
ataagtgtgcgagtttaa

SEQ ID NO: 1100 - DNA, 18 bp, Artificial Sequence
  Detection oligonucleotide for ARHI
ataagtgtgtgagtttaa

SEQ ID NO: 1101 - DNA, 18 bp, Artificial Sequence
  Detection oligonucleotide for ARHI
tatagttgcgtaggtagt

SEQ ID NO: 1102 - DNA, 18 bp, Artificial Sequence
  Detection oligonucleotide for ARHI
tatagttgtgtaggtagt

SEQ ID NO: 1103 - DNA, 18 bp, Artificial Sequence
  Detection oligonucleotide for BCL2
tgtttcgcgtgattgaag

SEQ ID NO: 1104 - DNA, 18 bp, Artificial Sequence
  Detection oligonucleotide for BCL2
tgttttgtgtgattgaag

SEQ ID NO: 1105 - DNA, 18 bp, Artificial Sequence
  Detection oligonucleotide for BCL2
agggtacgataatcggga

SEQ ID NO: 1106 - DNA, 18 bp, Artificial Sequence
  Detection oligonucleotide for BCL2
agggtatgataattggga

SEQ ID NO: 1107 - DNA, 18 bp, Artificial Sequence
  Detection oligonucleotide for BCL2
ggattcggtcgttaggat

SEQ ID NO: 1108 - DNA, 18 bp, Artificial Sequence
  Detection oligonucleotide for BCL2
ggatttggttgttaggat

SEQ ID NO: 1109 - DNA, 19 bp, Artificial Sequence
  Detection oligonucleotide for BCL2
gatttcgtcgagatgttta

SEQ ID NO: 1110 - DNA, 19 bp, Artificial Sequence
  Detection oligonucleotide for BCL2
gattttgttgagatgttta

SEQ ID NO: 1111 - DNA, 19 bp, Artificial Sequence
  Detection oligonucleotide for BRCA1
ataagcgcgtataggtttt

SEQ ID NO: 1112 - DNA, 19 bp, Artificial Sequence
  Detection oligonucleotide for BRCA1
ataagtgtgtataggtttt

SEQ ID NO: 1113 - DNA, 19 bp, Artificial Sequence
  Detection oligonucleotide for BRCA1
tttcgtaacgtatgttgga

SEQ ID NO: 1114 - DNA, 19 bp, Artificial Sequence
  Detection oligonucleotide for BRCA1
ttttgtaatgtatgttgga

SEQ ID NO: 1115 - DNA, 19 bp, Artificial Sequence
  Detection oligonucleotide for BRCA1
aataagtcgtaattggaag

SEQ ID NO: 1116 - DNA, 19 bp, Artificial Sequence
  Detection oligonucleotide for BRCA1
aataagttgtaattggaag

SEQ ID NO: 1117 - DNA, 19 bp, Artificial Sequence
  Detection oligonucleotide for BRCA1
tttacgttattcgggggta

SEQ ID NO: 1118 - DNA, 19 bp, Artificial Sequence
  Detection oligonucleotide for BRCA1
tttatgttatttgggggta

SEQ ID NO: 1119 - DNA, 18 bp, Artificial Sequence
  Detection oligonucleotide for CALCA
tatagcggcgggaataag

SEQ ID NO: 1120 - DNA, 18 bp, Artificial Sequence
  Detection oligonucleotide for CALCA
tatagtggtgggaataag

SEQ ID NO: 1121 - DNA, 20 bp, Artificial Sequence
  Detection oligonucleotide for CALCA
ttgttagttcgcgatttata

SEQ ID NO: 1122 - DNA, 20 bp, Artificial Sequence
  Detection oligonucleotide for CALCA
ttgttagtttgtgatttata

SEQ ID NO: 1123 - DNA, 19 bp, Artificial Sequence
  Detection oligonucleotide for CALCA
tttagggatcgcgtataga

SEQ ID NO: 1124 - DNA, 19 bp, Artificial Sequence
  Detection oligonucleotide for CALCA
tttagggattgtgtataga

SEQ ID NO: 1125 - DNA, 19 bp, Artificial Sequence
  Detection oligonucleotide for CALCA
aaatttttcgtagacggtg

SEQ ID NO: 1126 - DNA, 19 bp, Artificial Sequence
  Detection oligonucleotide for CALCA
aaattttttgtagatggtg

SEQ ID NO: 1127 - DNA, 18 bp, Artificial Sequence
  Detection oligonucleotide for CCND2
ggatcgcgtttgaagttg

SEQ ID NO: 1128 - DNA, 18 bp, Artificial Sequence
  Detection oligonucleotide for CCND2
ggattgtgtttgaagttg

SEQ ID NO: 1129 - DNA, 18 bp, Artificial Sequence
  Detection oligonucleotide for CCND2
ttttaataacgagagggg

SEQ ID NO: 1130 - DNA, 18 bp, Artificial Sequence
  Detection oligonucleotide for CCND2
ttttaataatgagagggg

SEQ ID NO: 1131 - DNA, 19 bp, Artificial Sequence
  Detection oligonucleotide for CCND2
tatcgttttagagcggaga

SEQ ID NO: 1132 - DNA, 19 bp, Artificial Sequence
  Detection oligonucleotide for CCND2
tattgttttagagtggaga

SEQ ID NO: 1133 - DNA, 18 bp, Artificial Sequence
  Detection oligonucleotide for CDH1
ttgggattcgaatttagt

SEQ ID NO: 1134 - DNA, 18 bp, Artificial Sequence
  Detection oligonucleotide for CDH1
ttgggatttgaatttagt

SEQ ID NO: 1135 - DNA, 18 bp, Artificial Sequence
  Detection oligonucleotide for CDH1
gagggttatcgcgtttat

SEQ ID NO: 1136 - DNA, 18 bp, Artificial Sequence
  Detection oligonucleotide for CDH1
gagggttattgtgtttat

SEQ ID NO: 1137 - DNA, 18 bp, Artificial Sequence
  Detection oligonucleotide for CDH1
ttaattagcggtacgggg

SEQ ID NO: 1138 - DNA, 18 bp, Artificial Sequence
  Detection oligonucleotide for CDH1
ttaattagtggtatgggg

SEQ ID NO: 1139 - DNA, 18 bp, Artificial Sequence
  Detection oligonucleotide for CDH1
tttagtggcgtcggaatt

SEQ ID NO: 1140 - DNA, 18 bp, Artificial Sequence
  Detection oligonucleotide for CDH1
tttagtggtgttggaatt

SEQ ID NO: 1141 - DNA, 19 bp, Artificial Sequence
  Detection oligonucleotide for CDKN1B
gttataatttcgggaaaga

SEQ ID NO: 1142 - DNA, 19 bp, Artificial Sequence
  Detection oligonucleotide for CDKN1B
gttataattttgggaaaga

SEQ ID NO: 1143 - DNA, 20 bp, Artificial Sequence
  Detection oligonucleotide for CDKN1B
ggacgagtttttatacgtag

SEQ ID NO: 1144 - DNA, 20 bp, Artificial Sequence
  Detection oligonucleotide for CDKN1B
ggatgagtttttatatgtag

SEQ ID NO: 1145 - DNA, 18 bp, Artificial Sequence
  Detection oligonucleotide for CDKN1B
tttgatttcgaggggagt

SEQ ID NO: 1146 - DNA, 18 bp, Artificial Sequence
  Detection oligonucleotide for CDKN1B
tttgattttgaggggagt

SEQ ID NO: 1147 - DNA, 18 bp, Artificial Sequence
  Detection oligonucleotide for CDKN1B
aagagaaacgttggaata

SEQ ID NO: 1148 - DNA, 18 bp, Artificial Sequence
  Detection oligonucleotide for CDKN1B
aagagaaatgttggaata

SEQ ID NO: 1149 - DNA, 19 bp, Artificial Sequence
  Detection oligonucleotide for CDKN1B
tagtatcggacgttaggat

SEQ ID NO: 1150 - DNA, 19 bp, Artificial Sequence
  Detection oligonucleotide for CDKN1B
tagtattggatgttaggat

SEQ ID NO: 1151 - DNA, 19 bp, Artificial Sequence
  Detection oligonucleotide for CDKN2A
tttttagtcgtataggtga

SEQ ID NO: 1152 - DNA, 19 bp, Artificial Sequence
  Detection oligonucleotide for CDKN2A
tttttagttgtataggtga

SEQ ID NO: 1153 - DNA, 18 bp, Artificial Sequence
  Detection oligonucleotide for CDKN2A
gttgtatcgcggaggaag

SEQ ID NO: 1154 - DNA, 18 bp, Artificial Sequence
  Detection oligonucleotide for CDKN2A
gttgtattgtggaggaag

SEQ ID NO: 1155 - DNA, 19 bp, Artificial Sequence
  Detection oligonucleotide for CDKN2A
attcgttaagtgttcggag

SEQ ID NO: 1156 - DNA, 19 bp, Artificial Sequence
  Detection oligonucleotide for CDKN2A
atttgttaagtgtttggag

SEQ ID NO: 1157 - DNA, 19 bp, Artificial Sequence
  Detection oligonucleotide for CDKN2A
gaaagatatcgcggttttt

SEQ ID NO: 1158 - DNA, 19 bp, Artificial Sequence
  Detection oligonucleotide for CDKN2A
gaaagatattgtggttttt

SEQ ID NO: 1159 - DNA, 18 bp, Artificial Sequence
  Detection oligonucleotide for CDKN2A
tttcgttagtatcggagg

SEQ ID NO: 1160 - DNA, 18 bp, Artificial Sequence
  Detection oligonucleotide for CDKN2A
ttttgttagtattggagg

SEQ ID NO: 1161 - DNA, 18 bp, Artificial Sequence
  Detection oligonucleotide for CDKN2A
ggagttttcggttgattg

SEQ ID NO: 1162 - DNA, 18 bp, Artificial Sequence
  Detection oligonucleotide for CDKN2A
ggagtttttggttgattg

SEQ ID NO: 1163 - DNA, 18 bp, Artificial Sequence
  Detection oligonucleotide for CDKN2A
gggcgttgtttaacgtat

SEQ ID NO: 1164 - DNA, 18 bp, Artificial Sequence
  Detection oligonucleotide for CDKN2A
gggtgttgtttaatgtat

SEQ ID NO: 1165 - DNA, 18 bp, Artificial Sequence
  Detection oligonucleotide for CDKN2A
aatagttacggtcggagg

SEQ ID NO: 1166 - DNA, 18 bp, Artificial Sequence
  Detection oligonucleotide for CDKN2A
aatagttatggttggagg

SEQ ID NO: 1167 - DNA, 18 bp, Artificial Sequence
  Detection oligonucleotide for CDKN2A
ggtcggaggtcgatttag

SEQ ID NO: 1168 - DNA, 18 bp, Artificial Sequence
  Detection oligonucleotide for CDKN2A
ggttggaggttgatttag

SEQ ID NO: 1169 - DNA, 19 bp, Artificial Sequence
  Detection oligonucleotide for CDKN2B
ggtttttcggcgattatag

SEQ ID NO: 1170 - DNA, 19 bp, Artificial Sequence
  Detection oligonucleotide for CDKN2B
ggttttttggtgattatag

SEQ ID NO: 1171 - DNA, 19 bp, Artificial Sequence
  Detection oligonucleotide for CDKN2B
aaagttcggagttaacgat

SEQ ID NO: 1172 - DNA, 19 bp, Artificial Sequence
  Detection oligonucleotide for CDKN2B
aaagtttggagttaatgat

SEQ ID NO: 1173 - DNA, 18 bp, Artificial Sequence
  Detection oligonucleotide for CDKN2B
agtttacggttaacggtg

SEQ ID NO: 1174 - DNA, 18 bp, Artificial Sequence
  Detection oligonucleotide for CDKN2B
agtttatggttaatggtg

SEQ ID NO: 1175 - DNA, 18 bp, Artificial Sequence
  Detection oligonucleotide for CDKN2B
aatgcgcgaggagaataa

SEQ ID NO: 1176 - DNA, 18 bp, Artificial Sequence
  Detection oligonucleotide for CDKN2B
aatgtgtgaggagaataa

SEQ ID NO: 1177 - DNA, 18 bp, Artificial Sequence
  Detection oligonucleotide for CD44
aaggttttacggttcggt

SEQ ID NO: 1178 - DNA, 18 bp, Artificial Sequence
  Detection oligonucleotide for CD44
aaggttttatggtttggt

SEQ ID NO: 1179 - DNA, 18 bp, Artificial Sequence
  Detection oligonucleotide for CD44
gtggggttcggaggtata

SEQ ID NO: 1180 - DNA, 18 bp, Artificial Sequence
  Detection oligonucleotide for CD44
gtggggtttggaggtata

SEQ ID NO: 1181 - DNA, 20 bp, Artificial Sequence
  Detection oligonucleotide for CD44
ggtatttcgcgatattttag

SEQ ID NO: 1182 - DNA, 20 bp, Artificial Sequence
  Detection oligonucleotide for CD44
ggtattttgtgatattttag

SEQ ID NO: 1183 - DNA, 20 bp, Artificial Sequence
  Detection oligonucleotide for CD44
gttcgtttcggatattatgg

SEQ ID NO: 1184 - DNA, 20 bp, Artificial Sequence
  Detection oligonucleotide for CD44
gtttgttttggatattatgg

SEQ ID NO: 1185 - DNA, 18 bp, Artificial Sequence
  Detection oligonucleotide for CD44
tttggcgtagatcggtga

SEQ ID NO: 1186 - DNA, 18 bp, Artificial Sequence
  Detection oligonucleotide for CD44
tttggtgtagattggtga

SEQ ID NO: 1187 - DNA, 18 bp, Artificial Sequence
  Detection oligonucleotide for CSPG2
ttgggtaacgtcgaattt

SEQ ID NO: 1188 - DNA, 18 bp, Artificial Sequence
  Detection oligonucleotide for CSPG2
ttgggtaatgttgaattt

SEQ ID NO: 1189 - DNA, 20 bp, Artificial Sequence
  Detection oligonucleotide for CSPG2
taataagtcgttttttaagg

SEQ ID NO: 1190 - DNA, 20 bp, Artificial Sequence
  Detection oligonucleotide for CSPG2
taataagttgttttttaagg

SEQ ID NO: 1191 - DNA, 20 bp, Artificial Sequence
  Detection oligonucleotide for CSPG2
aaaattcgcgagtttagaaa

SEQ ID NO: 1192 - DNA, 20 bp, Artificial Sequence
  Detection oligonucleotide for CSPG2
aaaatttgtgagtttagaaa

SEQ ID NO: 1193 - DNA, 18 bp, Artificial Sequence
  Detection oligonucleotide for DAPK1
gaagggagcgtattttat

SEQ ID NO: 1194 - DNA, 18 bp, Artificial Sequence
  Detection oligonucleotide for DAPK1
gaagggagtgtattttat

SEQ ID NO: 1195 - DNA, 18 bp, Artificial Sequence
  Detection oligonucleotide for DAPK1
tgtttttcggaaatttgt

SEQ ID NO: 1196 - DNA, 18 bp, Artificial Sequence
  Detection oligonucleotide for DAPK1
tgttttttggaaatttgt

SEQ ID NO: 1197 - DNA, 19 bp, Artificial Sequence
  Detection oligonucleotide for DAPK1
tttcgtttcgagatgtgta

SEQ ID NO: 1198 - DNA, 19 bp, Artificial Sequence
  Detection oligonucleotide for DAPK1
ttttgttttgagatgtgta

SEQ ID NO: 1199 - DNA, 20 bp, Artificial Sequence
  Detection oligonucleotide for DAPK1
ggaaatacggttttttcgtt

SEQ ID NO: 1200 - DNA, 20 bp, Artificial Sequence
  Detection oligonucleotide for DAPK1
ggaaatatggtttttttgtt

SEQ ID NO: 1201 - DNA, 20 bp, Artificial Sequence
  Detection oligonucleotide for GGT1
tatattatcggttttaggtt

SEQ ID NO: 1202 - DNA, 20 bp, Artificial Sequence
  Detection oligonucleotide for GGT1
tatattattggttttaggtt

SEQ ID NO: 1203 - DNA, 20 bp, Artificial Sequence
  Detection oligonucleotide for GGT1
gggattttattcgtagatta

SEQ ID NO: 1204 - DNA, 20 bp, Artificial Sequence
  Detection oligonucleotide for GGT1
gggattttatttgtagatta

SEQ ID NO: 1205 - DNA, 18 bp, Artificial Sequence
  Detection oligonucleotide for GGT1
gaggttagacgttttgta

SEQ ID NO: 1206 - DNA, 18 bp, Artificial Sequence
  Detection oligonucleotide for GGT1
gaggttagatgttttgta

SEQ ID NO: 1207 - DNA, 19 bp, Artificial Sequence
  Detection oligonucleotide for GGT1
tagatatcgttttttgtgg

SEQ ID NO: 1208 - DNA, 19 bp, Artificial Sequence
  Detection oligonucleotide for GGT1
tagatattgttttttgtgg

SEQ ID NO: 1209 - DNA, 18 bp, Artificial Sequence
  Detection oligonucleotide for GSTP1
ggttttttcggttagttg

SEQ ID NO: 1210 - DNA, 18 bp, Artificial Sequence
  Detection oligonucleotide for GSTP1
ggtttttttggttagttg

SEQ ID NO: 1211 - DNA, 18 bp, Artificial Sequence
  Detection oligonucleotide for GSTP1
ttttagggcgtttttttg

SEQ ID NO: 1212 - DNA, 18 bp, Artificial Sequence
  Detection oligonucleotide for GSTP1
ttttagggtgtttttttg

SEQ ID NO: 1213 - DNA, 18 bp, Artificial Sequence
  Detection oligonucleotide for GSTP1
agttcgcgggatttttta

SEQ ID NO: 1214 - DNA, 18 bp, Artificial Sequence
  Detection oligonucleotide for GSTP1
agtttgtgggatttttta

SEQ ID NO: 1215 - DNA, 20 bp, Artificial Sequence
  Detection oligonucleotide for GSTP1
tagttttcgttattagtgag

SEQ ID NO: 1216 - DNA, 20 bp, Artificial Sequence
  Detection oligonucleotide for GSTP1
tagtttttgttattagtgag

SEQ ID NO: 1217 - DNA, 18 bp, Artificial Sequence
  Detection oligonucleotide for HIC1
gaagtttacgcgggattt

SEQ ID NO: 1218 - DNA, 18 bp, Artificial Sequence
  Detection oligonucleotide for HIC1
gaagtttatgtgggattt

SEQ ID NO: 1219 - DNA, 18 bp, Artificial Sequence
  Detection oligonucleotide for HIC1
taaaacggcgtatagggg

SEQ ID NO: 1220 - DNA, 18 bp, Artificial Sequence
  Detection oligonucleotide for HIC1
taaaatggtgtatagggg

SEQ ID NO: 1221 - DNA, 19 bp, Artificial Sequence
  Detection oligonucleotide for HIC1
ttttagtcgttttgatgat

SEQ ID NO: 1222 - DNA, 19 bp, Artificial Sequence
  Detection oligonucleotide for HIC1
ttttagttgttttgatgat

SEQ ID NO: 1223 - DNA, 19 bp, Artificial Sequence
  Detection oligonucleotide for HIC1
taggagattcgaaagttta

SEQ ID NO: 1224 - DNA, 19 bp, Artificial Sequence
  Detection oligonucleotide for HIC1
taggagatttgaaagttta

SEQ ID NO: 1225 - DNA, 19 bp, Artificial Sequence
  Detection oligonucleotide for STK11
gggttaagcgtcgattaat

SEQ ID NO: 1226 - DNA, 19 bp, Artificial Sequence
  Detection oligonucleotide for STK11
gggttaagtgttgattaat

SEQ ID NO: 1227 - DNA, 18 bp, Artificial Sequence
  Detection oligonucleotide for STK11
agggaggtcgttggtatt

SEQ ID NO: 1228 - DNA, 18 bp, Artificial Sequence
  Detection oligonucleotide for STK11
agggaggttgttggtatt

SEQ ID NO: 1229 - DNA, 20 bp, Artificial Sequence
  Detection oligonucleotide for STK11
ggtattcgtgatttacgatt

SEQ ID NO: 1230 - DNA, 20 bp, Artificial Sequence
  Detection oligonucleotide for STK11
ggtatttgtgatttatgatt

SEQ ID NO: 1231 - DNA, 19 bp, Artificial Sequence
  Detection oligonucleotide for STK11
tttcgagttttatcgaggt

SEQ ID NO: 1232 - DNA, 19 bp, Artificial Sequence
  Detection oligonucleotide for STK11
ttttgagttttattgaggt

SEQ ID NO: 1233 - DNA, 19 bp, Artificial Sequence
  Detection oligonucleotide for STK11
attaatgagcgcgttgtat

SEQ ID NO: 1234 - DNA, 19 bp, Artificial Sequence
  Detection oligonucleotide for STK11
attaatgagtgtgttgtat

SEQ ID NO: 1235 - DNA, 18 bp, Artificial Sequence
  Detection oligonucleotide for ING4
tagtgacgagaaggttat

SEQ ID NO: 1236 - DNA, 18 bp, Artificial Sequence
  Detection oligonucleotide for ING4
tagtgatgagaaggttat

SEQ ID NO: 1237 - DNA, 18 bp, Artificial Sequence
  Detection oligonucleotide for ING4
aattatgaagcggttttg

SEQ ID NO: 1238 - DNA, 18 bp, Artificial Sequence
  Detection oligonucleotide for ING4
aattatgaagtggttttg

SEQ ID NO: 1239 - DNA, 18 bp, Artificial Sequence
  Detection oligonucleotide for ING4
ttagagacgtgttttgaa

SEQ ID NO: 1240 - DNA, 18 bp, Artificial Sequence
  Detection oligonucleotide for ING4
ttagagatgtgttttgaa

SEQ ID NO: 1241 - DNA, 18 bp, Artificial Sequence
  Detection oligonucleotide for MGMT
ttaggttatcggtgattg

SEQ ID NO: 1242 - DNA, 18 bp, Artificial Sequence
  Detection oligonucleotide for MGMT
ttaggttattggtgattg

SEQ ID NO: 1243 - DNA, 19 bp, Artificial Sequence
  Detection oligonucleotide for MGMT
tttggacggtatcgtttat

SEQ ID NO: 1244 - DNA, 19 bp, Artificial Sequence
  Detection oligonucleotide for MGMT
tttggatggtattgtttat

SEQ ID NO: 1245 - DNA, 19 bp, Artificial Sequence
  Detection oligonucleotide for MGMT
tagtcgtttcgagtaggat

SEQ ID NO: 1246 - DNA, 19 bp, Artificial Sequence
  Detection oligonucleotide for MGMT
tagttgttttgagtaggat

SEQ ID NO: 1247 - DNA, 18 bp, Artificial Sequence
  Detection oligonucleotide for MGMT
agtaggatcgggattttt

SEQ ID NO: 1248 - DNA, 18 bp, Artificial Sequence
  Detection oligonucleotide for MGMT
agtaggattgggattttt

SEQ ID NO: 1249 - DNA, 18 bp, Artificial Sequence
  Detection oligonucleotide for MGMT
ttattcgggtacgtggta

SEQ ID NO: 1250 - DNA, 18 bp, Artificial Sequence
  Detection oligonucleotide for MGMT
ttatttgggtatgtggta

SEQ ID NO: 1251 - DNA, 19 bp, Artificial Sequence
  Detection oligonucleotide for MLH1
ataagttcggtttcggtat

SEQ ID NO: 1252 - DNA, 19 bp, Artificial Sequence
  Detection oligonucleotide for MLH1
ataagtttggttttggtat

SEQ ID NO: 1253 - DNA, 18 bp, Artificial Sequence
  Detection oligonucleotide for MLH1
aagagcggatagcgattt

SEQ ID NO: 1254 - DNA, 18 bp, Artificial Sequence
  Detection oligonucleotide for MLH1
aagagtggatagtgattt

SEQ ID NO: 1255 - DNA, 18 bp, Artificial Sequence
  Detection oligonucleotide for MLH1
gaacgtgagtacgaggta

SEQ ID NO: 1256 - DNA, 18 bp, Artificial Sequence
  Detection oligonucleotide for MLH1
gaatgtgagtatgaggta

SEQ ID NO: 1257 - DNA, 18 bp, Artificial Sequence
  Detection oligonucleotide for MLH1
taaaatgtcgttcgtggt

SEQ ID NO: 1258 - DNA, 18 bp, Artificial Sequence
  Detection oligonucleotide for MLH1
taaaatgttgtttgtggt

SEQ ID NO: 1259 - DNA, 20 bp, Artificial Sequence
  Detection oligonucleotide for CA9
tatggtttcgataatttttt

SEQ ID NO: 1260 - DNA, 20 bp, Artificial Sequence
  Detection oligonucleotide for CA9
tatggttttgataatttttt

SEQ ID NO: 1261 - DNA, 18 bp, Artificial Sequence
  Detection oligonucleotide for CA9
atatatcgtgtgttggga

SEQ ID NO: 1262 - DNA, 18 bp, Artificial Sequence
  Detection oligonucleotide for CA9
atatattgtgtgttggga

SEQ ID NO: 1263 - DNA, 19 bp, Artificial Sequence
  Detection oligonucleotide for CA9
atagttagtcgtatggttt

SEQ ID NO: 1264 - DNA, 19 bp, Artificial Sequence
  Detection oligonucleotide for CA9
atagttagttgtatggttt

SEQ ID NO: 1265 - DNA, 18 bp, Artificial Sequence
  Detection oligonucleotide for MYC
gggatcgcgttgagtata

SEQ ID NO: 1266 - DNA, 18 bp, Artificial Sequence
  Detection oligonucleotide for MYC
gggattgtgttgagtata

SEQ ID NO: 1267 - DNA, 18 bp, Artificial Sequence
  Detection oligonucleotide for MYC
gagattcggagcgaatag

SEQ ID NO: 1268 - DNA, 18 bp, Artificial Sequence
  Detection oligonucleotide for MYC
gagatttggagtgaatag

SEQ ID NO: 1269 - DNA, 19 bp, Artificial Sequence
  Detection oligonucleotide for MYC
agttagcggttcgtaattt

SEQ ID NO: 1270 - DNA, 19 bp, Artificial Sequence
  Detection oligonucleotide for MYC
agttagtggtttgtaattt

SEQ ID NO: 1271 - DNA, 18 bp, Artificial Sequence
  Detection oligonucleotide for MYC
gagtaaggacgcgatttt

SEQ ID NO: 1272 - DNA, 18 bp, Artificial Sequence
  Detection oligonucleotide for MYC
gagtaaggatgtgatttt

SEQ ID NO: 1273 - DNA, 18 bp, Artificial Sequence
  Detection oligonucleotide for N33
ttggttcgggaaaggtaa

SEQ ID NO: 1274 - DNA, 18 bp, Artificial Sequence
  Detection oligonucleotide for N33
ttggtttgggaaaggtaa

SEQ ID NO: 1275 - DNA, 18 bp, Artificial Sequence
  Detection oligonucleotide for N33
ttttcggtgaatcggatg

SEQ ID NO: 1276 - DNA, 18 bp, Artificial Sequence
  Detection oligonucleotide for N33
tttttggtgaattggatg

SEQ ID NO: 1277 - DNA, 18 bp, Artificial Sequence
  Detection oligonucleotide for N33
tgttatttcggagggttt

SEQ ID NO: 1278 - DNA, 18 bp, Artificial Sequence
  Detection oligonucleotide for N33
tgttattttggagggttt

SEQ ID NO: 1279 - DNA, 18 bp, Artificial Sequence
  Detection oligonucleotide for N33
gtttagttagcgggtttt

SEQ ID NO: 1280 - DNA, 18 bp, Artificial Sequence
  Detection oligonucleotide for N33
gtttagttagtgggtttt

SEQ ID NO: 1281 - DNA, 20 bp, Artificial Sequence
  Detection oligonucleotide for N33
ttttttacgtcgtaggtaag

SEQ ID NO: 1282 - DNA, 20 bp, Artificial Sequence
  Detection oligonucleotide for N33
ttttttatgttgtaggtaag

SEQ ID NO: 1283 - DNA, 18 bp, Artificial Sequence
  Detection oligonucleotide for N33
atttagttcgggggagga

SEQ ID NO: 1284 - DNA, 18 bp, Artificial Sequence
  Detection oligonucleotide for N33
atttagtttgggggagga

SEQ ID NO: 1285 - DNA, 18 bp, Artificial Sequence
  Detection oligonucleotide for PAX6
gagggttatgcgatttta

SEQ ID NO: 1286 - DNA, 18 bp, Artificial Sequence
  Detection oligonucleotide for PAX6
gagggttatgtgatttta

SEQ ID NO: 1287 - DNA, 18 bp, Artificial Sequence
  Detection oligonucleotide for PAX6
tattgtttcggttgttag

SEQ ID NO: 1288 - DNA, 18 bp, Artificial Sequence
  Detection oligonucleotide for PAX6
tattgttttggttgttag

SEQ ID NO: 1289 - DNA, 18 bp, Artificial Sequence
  Detection oligonucleotide for PAX6
ttagtagcgagtttaggt

SEQ ID NO: 1290 - DNA, 18 bp, Artificial Sequence
  Detection oligonucleotide for PAX6
ttagtagtgagtttaggt

SEQ ID NO: 1291 - DNA, 19 bp, Artificial Sequence
  Detection oligonucleotide for PAX6
gtttaggtcgcgtagattt

SEQ ID NO: 1292 - DNA, 19 bp, Artificial Sequence
  Detection oligonucleotide for PAX6
gtttaggttgtgtagattt

SEQ ID NO: 1293 - DNA, 20 bp, Artificial Sequence
  Detection oligonucleotide for PAX6
agtttagcgtatttttcggt

SEQ ID NO: 1294 - DNA, 20 bp, Artificial Sequence
  Detection oligonucleotide for PAX6
agtttagtgtattttttggt

SEQ ID NO: 1295 - DNA, 19 bp, Artificial Sequence
  Detection oligonucleotide for X51730 PGR
tgtatcgagaggttcgatt

SEQ ID NO: 1296 - DNA, 19 bp, Artificial Sequence
  Detection oligonucleotide for X51730 PGR
tgtattgagaggtttgatt

SEQ ID NO: 1297 - DNA, 18 bp, Artificial Sequence
  Detection oligonucleotide for X51730 PGR
aggagtcgcgtgttatta

SEQ ID NO: 1298 - DNA, 18 bp, Artificial Sequence
  Detection oligonucleotide for X51730 PGR
aggagttgtgtgttatta

SEQ ID NO: 1299 - DNA, 18 bp, Artificial Sequence
  Detection oligonucleotide for X51730 PGR
gttaggagacgagatttt

SEQ ID NO: 1300 - DNA, 18 bp, Artificial Sequence
  Detection oligonucleotide for X51730 PGR
gttaggagatgagatttt

SEQ ID NO: 1301 - DNA, 18 bp, Artificial Sequence
  Detection oligonucleotide for X51730 PGR
tgtcgttcgttgggataa

SEQ ID NO: 1302 - DNA, 18 bp, Artificial Sequence
  Detection oligonucleotide for X51730 PGR
tgttgtttgttgggataa

SEQ ID NO: 1303 - DNA, 19 bp, Artificial Sequence
  Detection oligonucleotide for PTEN
tttgcgttcgtatttagag

SEQ ID NO: 1304 - DNA, 19 bp, Artificial Sequence
  Detection oligonucleotide for PTEN
tttgtgtttgtatttagag

SEQ ID NO: 1305 - DNA, 19 bp, Artificial Sequence
  Detection oligonucleotide for PTEN
ttagagttatcgttttgtt

SEQ ID NO: 1306 - DNA, 19 bp, Artificial Sequence
  Detection oligonucleotide for PTEN
ttagagttattgttttgtt

SEQ ID NO: 1307 - DNA, 18 bp, Artificial Sequence
  Detection oligonucleotide for PTEN
tgatgtggcgggattttt

SEQ ID NO: 1308 - DNA, 18 bp, Artificial Sequence
  Detection oligonucleotide for PTEN
tgatgtggtgggattttt

SEQ ID NO: 1309 - DNA, 18 bp, Artificial Sequence
  Detection oligonucleotide for PTEN
ttttttcggaagttgtag

SEQ ID NO: 1310 - DNA, 18 bp, Artificial Sequence
  Detection oligonucleotide for PTEN
tttttttggaagttgtag

SEQ ID NO: 1311 - DNA, 18 bp, Artificial Sequence
  Detection oligonucleotide for RARB
tagtagttcgggtagggt

SEQ ID NO: 1312 - DNA, 18 bp, Artificial Sequence
  Detection oligonucleotide for RARB
tagtagtttgggtagggt

SEQ ID NO: 1313 - DNA, 18 bp, Artificial Sequence
  Detection oligonucleotide for RARB
agggtttatcgaaagttt

SEQ ID NO: 1314 - DNA, 18 bp, Artificial Sequence
  Detection oligonucleotide for RARB
agggtttattgaaagttt

SEQ ID NO: 1315 - DNA, 18 bp, Artificial Sequence
  Detection oligonucleotide for RARB
gagcgattcgagtagggt

SEQ ID NO: 1316 - DNA, 18 bp, Artificial Sequence
  Detection oligonucleotide for RARB
gagtgatttgagtagggt

SEQ ID NO: 1317 - DNA, 18 bp, Artificial Sequence
  Detection oligonucleotide for RARB
gtatcgtcggggtaggat

SEQ ID NO: 1318 - DNA, 18 bp, Artificial Sequence
  Detection oligonucleotide for RARB
gtattgttggggtaggat

SEQ ID NO: 1319 - DNA, 18 bp, Artificial Sequence
  Detection oligonucleotide for RARB
gaacgtattcggaaggtt

SEQ ID NO: 1320 - DNA, 18 bp, Artificial Sequence
  Detection oligonucleotide for RARB
gaatgtatttggaaggtt

SEQ ID NO: 1321 - DNA, 18 bp, Artificial Sequence
  Detection oligonucleotide for TFF1
tattttggtcgaggttta

SEQ ID NO: 1322 - DNA, 18 bp, Artificial Sequence
  Detection oligonucleotide for TFF1
tattttggttgaggttta

SEQ ID NO: 1323 - DNA, 19 bp, Artificial Sequence
  Detection oligonucleotide for TFF1
agatagagacgtgtatagt

SEQ ID NO: 1324 - DNA, 19 bp, Artificial Sequence
  Detection oligonucleotide for TFF1
agatagagatgtgtatagt

SEQ ID NO: 1325 - DNA, 18 bp, Artificial Sequence
  Detection oligonucleotide for TFF1
tggtttttcgtgaaagat

SEQ ID NO: 1326 - DNA, 18 bp, Artificial Sequence
  Detection oligonucleotide for TFF1
tggttttttgtgaaagat

SEQ ID NO: 1327 - DNA, 19 bp, Artificial Sequence
  Detection oligonucleotide for TFF1
aatattatcgacgtttttt

SEQ ID NO: 1328 - DNA, 21 bp, Artificial Sequence
  Detection oligonucleotide for TFF1
attattgatgtttttttagaa

SEQ ID NO: 1329 - DNA, 18 bp, Artificial Sequence
  Detection oligonucleotide for TIMP3
gtttttcgttggagaaaa

SEQ ID NO: 1330 - DNA, 18 bp, Artificial Sequence
  Detection oligonucleotide for TIMP3
gttttttgttggagaaaa

SEQ ID NO: 1331 - DNA, 19 bp, Artificial Sequence
  Detection oligonucleotide for TIMP3
gaaaatatcggtattttgg

SEQ ID NO: 1332 - DNA, 19 bp, Artificial Sequence
  Detection oligonucleotide for TIMP3
gaaaatattggtattttgg

SEQ ID NO: 1333 - DNA, 18 bp, Artificial Sequence
  Detection oligonucleotide for TIMP3
atgtggggcgcggggata

SEQ ID NO: 1334 - DNA, 18 bp, Artificial Sequence
  Detection oligonucleotide for TIMP3
atgtggggtgtggggata

SEQ ID NO: 1335 - DNA, 19 bp, Artificial Sequence
  Detection oligonucleotide for TIMP3
gggataagcgaatttttta

SEQ ID NO: 1336 - DNA, 19 bp, Artificial Sequence
  Detection oligonucleotide for TIMP3
gggataagtgaatttttta

SEQ ID NO: 1337 - DNA, 18 bp, Artificial Sequence
  Detection oligonucleotide for VHL
tataagcgtgatgattgg

SEQ ID NO: 1338 - DNA, 18 bp, Artificial Sequence
  Detection oligonucleotide for VHL
tataagtgtgatgattgg

SEQ ID NO: 1339 - DNA, 19 bp, Artificial Sequence
  Detection oligonucleotide for VHL
tttcgtgtgagatgcgtta

SEQ ID NO: 1340 - DNA, 19 bp, Artificial Sequence
  Detection oligonucleotide for VHL
ttttgtgtgagatgtgtta

SEQ ID NO: 1341 - DNA, 19 bp, Artificial Sequence
  Detection oligonucleotide for VHL
gagatgcgttattttcgaa

SEQ ID NO: 1342 - DNA, 19 bp, Artificial Sequence
  Detection oligonucleotide for VHL
gagatgtgttatttttgaa

SEQ ID NO: 1343 - DNA, 19 bp, Artificial Sequence
  Detection oligonucleotide for VHL
tattgcgcgtttgatatga

SEQ ID NO: 1344 - DNA, 19 bp, Artificial Sequence
  Detection oligonucleotide for VHL
tattgtgtgtttgatatga

SEQ ID NO: 1345 - DNA, 18 bp, Artificial Sequence
  Detection oligonucleotide for CDKN1C
atgaagaacggttaaggg

SEQ ID NO: 1346 - DNA, 18 bp, Artificial Sequence
  Detection oligonucleotide for CDKN1C
atgaagaatggttaaggg

SEQ ID NO: 1347 - DNA, 19 bp, Artificial Sequence
  Detection oligonucleotide for CDKN1C
tatttcgagttaggtcgaa

SEQ ID NO: 1348 - DNA, 19 bp, Artificial Sequence
  Detection oligonucleotide for CDKN1C
tattttgagttaggttgaa

SEQ ID NO: 1349 - DNA, 18 bp, Artificial Sequence
  Detection oligonucleotide for CDKN1C
aattagtcggggtcgtga

SEQ ID NO: 1350 - DNA, 18 bp, Artificial Sequence
  Detection oligonucleotide for CDKN1C
aattagttggggttgtga

SEQ ID NO: 1351 - DNA, 18 bp, Artificial Sequence
  Detection oligonucleotide for CDKN1C
ttagtgttcgtttggaat

SEQ ID NO: 1352 - DNA, 18 bp, Artificial Sequence
  Detection oligonucleotide for CDKN1C
ttagtgtttgtttggaat

SEQ ID NO: 1353 - DNA, 20 bp, Artificial Sequence
  Detection oligonucleotide for CAV1
taaatatttcgattgttgat

SEQ ID NO: 1354 - DNA, 21 bp, Artificial Sequence
  Detection oligonucleotide for CAV1
ttttaaatattttgattgttg

SEQ ID NO: 1355 - DNA, 18 bp, Artificial Sequence
  Detection oligonucleotide for CAV1
ttggtatcgttgaagaat

SEQ ID NO: 1356 - DNA, 18 bp, Artificial Sequence
  Detection oligonucleotide for CAV1
ttggtattgttgaagaat

SEQ ID NO: 1357 - DNA, 18 bp, Artificial Sequence
  Detection oligonucleotide for CAV1
taagacgcgttttttgga

SEQ ID NO: 1358 - DNA, 18 bp, Artificial Sequence
  Detection oligonucleotide for CAV1
taagatgtgttttttgga

SEQ ID NO: 1359 - DNA, 19 bp, Artificial Sequence
  Detection oligonucleotide for CAV1
aatacgtagattcggaggt

SEQ ID NO: 1360 - DNA, 19 bp, Artificial Sequence
  Detection oligonucleotide for CAV1
aatatgtagatttggaggt

SEQ ID NO: 1361 - DNA, 18 bp, Artificial Sequence
  Detection oligonucleotide for CAV1
tagattcggaggtaggta

SEQ ID NO: 1362 - DNA, 18 bp, Artificial Sequence
  Detection oligonucleotide for CAV1
tagatttggaggtaggta

SEQ ID NO: 1363 - DNA, 18 bp, Artificial Sequence
  Detection oligonucleotide for CDH13
taaaacgagggagcgtta

SEQ ID NO: 1364 - DNA, 18 bp, Artificial Sequence
  Detection oligonucleotide for CDH13
taaaatgagggagtgtta

SEQ ID NO: 1365 - DNA, 19 bp, Artificial Sequence
  Detection oligonucleotide for CDH13
aaggaattcgttttgtaaa

SEQ ID NO: 1366 - DNA, 19 bp, Artificial Sequence
  Detection oligonucleotide for CDH13
aaggaatttgttttgtaaa

SEQ ID NO: 1367 - DNA, 18 bp, Artificial Sequence
  Detection oligonucleotide for CDH13
aagtggtcgttagttttt

SEQ ID NO: 1368 - DNA, 18 bp, Artificial Sequence
  Detection oligonucleotide for CDH13
aagtggttgttagttttt

SEQ ID NO: 1369 - DNA, 18 bp, Artificial Sequence
  Detection oligonucleotide for NDRG1
gagtaggacggtgttaag

SEQ ID NO: 1370 - DNA, 18 bp, Artificial Sequence
  Detection oligonucleotide for NDRG1
gagtaggatggtgttaag

SEQ ID NO: 1371 - DNA, 19 bp, Artificial Sequence
  Detection oligonucleotide for NDRG1
taaatttaacgttgggtag

SEQ ID NO: 1372 - DNA, 19 bp, Artificial Sequence
  Detection oligonucleotide for NDRG1
taaatttaatgttgggtag

SEQ ID NO: 1373 - DNA, 18 bp, Artificial Sequence
  Detection oligonucleotide for NDRG1
gataatgacggtgttagt

SEQ ID NO: 1374 - DNA, 18 bp, Artificial Sequence
  Detection oligonucleotide for NDRG1
gataatgatggtgttagt

SEQ ID NO: 1375 - DNA, 18 bp, Artificial Sequence
  Detection oligonucleotide for NDRG1
gttgtacgttaggagtta

SEQ ID NO: 1376 - DNA, 18 bp, Artificial Sequence
  Detection oligonucleotide for NDRG1
gttgtatgttaggagtta

SEQ ID NO: 1377 - DNA, 19 bp, Artificial Sequence
  Detection oligonucleotide for PTGS2
attggttttcggaagcgtt

SEQ ID NO: 1378 - DNA, 19 bp, Artificial Sequence
  Detection oligonucleotide for PTGS2
attggtttttggaagtgtt

SEQ ID NO: 1379 - DNA, 18 bp, Artificial Sequence
  Detection oligonucleotide for PTGS2
aagcgttcgggtaaagat

SEQ ID NO: 1380 - DNA, 18 bp, Artificial Sequence
  Detection oligonucleotide for PTGS2
aagtgtttgggtaaagat

SEQ ID NO: 1381 - DNA, 18 bp, Artificial Sequence
  Detection oligonucleotide for THBS1
tattttacggggacggtg

SEQ ID NO: 1382 - DNA, 18 bp, Artificial Sequence
  Detection oligonucleotide for THBS1
tattttatggggatggtg

SEQ ID NO: 1383 - DNA, 19 bp, Artificial Sequence
  Detection oligonucleotide for THBS1
gattagttcgttcgaaagt

SEQ ID NO: 1384 - DNA, 19 bp, Artificial Sequence
  Detection oligonucleotide for THBS1
gattagtttgtttgaaagt

SEQ ID NO: 1385 - DNA, 18 bp, Artificial Sequence
  Detection oligonucleotide for THBS1
gtggcgtaagagtacgag

SEQ ID NO: 1386 - DNA, 18 bp, Artificial Sequence
  Detection oligonucleotide for THBS1
gtggtgtaagagtatgag

SEQ ID NO: 1387 - DNA, 18 bp, Artificial Sequence
  Detection oligonucleotide for TMEFF2
ataggttacgggttggag

SEQ ID NO: 1388 - DNA, 18 bp, Artificial Sequence
  Detection oligonucleotide for TMEFF2
ataggttatgggttggag

SEQ ID NO: 1389 - DNA, 18 bp, Artificial Sequence
  Detection oligonucleotide for TMEFF2
aaatttgcgaacgtttgg

SEQ ID NO: 1390 - DNA, 18 bp, Artificial Sequence
  Detection oligonucleotide for TMEFF2
aaatttgtgaatgtttgg

SEQ ID NO: 1391 - DNA, 18 bp, Artificial Sequence
  Detection oligonucleotide for TMEFF2
aaatggagttcgtttttt

SEQ ID NO: 1392 - DNA, 18 bp, Artificial Sequence
  Detection oligonucleotide for TMEFF2
aaatggagtttgtttttt

SEQ ID NO: 1393 - DNA, 18 bp, Artificial Sequence
  Detection oligonucleotide for TMEFF2
ggtcgatgttttcggtaa

SEQ ID NO: 1394 - DNA, 18 bp, Artificial Sequence
  Detection oligonucleotide for TMEFF2
ggttgatgtttttggtaa

SEQ ID NO: 1395 - DNA, 18 bp, Artificial Sequence
  Detection oligonucleotide for PLAU
tgaggtttcgttttaaga

SEQ ID NO: 1396 - DNA, 18 bp, Artificial Sequence
  Detection oligonucleotide for PLAU
tgaggttttgttttaaga

SEQ ID NO: 1397 - DNA, 18 bp, Artificial Sequence
  Detection oligonucleotide for PLAU
ttatttacgtgtgtggag

SEQ ID NO: 1398 - DNA, 18 bp, Artificial Sequence
  Detection oligonucleotide for PLAU
ttatttatgtgtgtggag

SEQ ID NO: 1399 - DNA, 20 bp, Artificial Sequence
  Detection oligonucleotide for PLAU
ggtgattagcgttatatatt

SEQ ID NO: 1400 - DNA, 20 bp, Artificial Sequence
  Detection oligonucleotide for PLAU
ggtgattagtgttatatatt

SEQ ID NO: 1401 - DNA, 18 bp, Artificial Sequence
  Detection oligonucleotide for PLAU
gataagtcgtgttttgag

SEQ ID NO: 1402 - DNA, 18 bp, Artificial Sequence
  Detection oligonucleotide for PLAU
gataagttgtgttttgag

SEQ ID NO: 1403 - DNA, 18 bp, Artificial Sequence
  Detection oligonucleotide for TMEFF2
tagttcgttcggtgaagt

SEQ ID NO: 1404 - DNA, 18 bp, Artificial Sequence
  Detection oligonucleotide for TMEFF2
tagtttgtttggtgaagt

SEQ ID NO: 1405 - DNA, 18 bp, Artificial Sequence
  Detection oligonucleotide for TMEFF2
gtgaagttcgttgttttt

SEQ ID NO: 1406 - DNA, 18 bp, Artificial Sequence
  Detection oligonucleotide for TMEFF2
gtgaagtttgttgttttt

SEQ ID NO: 1407 - DNA, 19 bp, Artificial Sequence
  Detection oligonucleotide for TMEFF2
ttaaacgtttatcggttgg

SEQ ID NO: 1408 - DNA, 19 bp, Artificial Sequence
  Detection oligonucleotide for TMEFF2
ttaaatgtttattggttgg

SEQ ID NO: 1409 - DNA, 20 bp, Artificial Sequence
  Detection oligonucleotide for TMEFF2
tttaatttcgtagaagaata

SEQ ID NO: 1410 - DNA, 21 bp, Artificial Sequence
  Detection oligonucleotide for TMEFF2
ttttaattttgtagaagaata

SEQ ID NO: 1411 - DNA, 20 bp, Artificial Sequence
  Detection oligonucleotide for TMEFF2
gaagaatacgcgtatttagt

SEQ ID NO: 1412 - DNA, 20 bp, Artificial Sequence
  Detection oligonucleotide for TMEFF2
gaagaatatgtgtatttagt

SEQ ID NO: 1413 - DNA, 18 bp, Artificial Sequence
  Detection oligonucleotide for DNMT1
gtacggtgttcgaggtat

SEQ ID NO: 1414 - DNA, 18 bp, Artificial Sequence
  Detection oligonucleotide for DNMT1
gtatggtgtttgaggtat

SEQ ID NO: 1415 - DNA, 18 bp, Artificial Sequence
  Detection oligonucleotide for DNMT1
tttttacgcggagtagtg

SEQ ID NO: 1416 - DNA, 18 bp, Artificial Sequence
  Detection oligonucleotide for DNMT1
tttttatgtggagtagtg

SEQ ID NO: 1417 - DNA, 19 bp, Artificial Sequence
  Detection oligonucleotide for DNMT1
gggaatacgtatgcgtaag

SEQ ID NO: 1418 - DNA, 19 bp, Artificial Sequence
  Detection oligonucleotide for DNMT1
gggaatatgtatgtgtaag

SEQ ID NO: 1419 - DNA, 18 bp, Artificial Sequence
  Detection oligonucleotide for DNMT1
gaacggagtcggttatgt

SEQ ID NO: 1420 - DNA, 18 bp, Artificial Sequence
  Detection oligonucleotide for DNMT1
gaatggagttggttatgt

SEQ ID NO: 1421 - DNA, 18 bp, Artificial Sequence
  Detection oligonucleotide for DNMT1
aaacggagagaggcgata

SEQ ID NO: 1422 - DNA, 18 bp, Artificial Sequence
  Detection oligonucleotide for DNMT1
aaatggagagaggtgata

SEQ ID NO: 1423 - DNA, 18 bp, Artificial Sequence
  Detection oligonucleotide for ESR1
ttttttggtcgtgaaatt

SEQ ID NO: 1424 - DNA, 18 bp, Artificial Sequence
  Detection oligonucleotide for ESR1
ttttttggttgtgaaatt

SEQ ID NO: 1425 - DNA, 20 bp, Artificial Sequence
  Detection oligonucleotide for ESR1
tttagtagcgacgataagta

SEQ ID NO: 1426 - DNA, 20 bp, Artificial Sequence
  Detection oligonucleotide for ESR1
tttagtagtgatgataagta

SEQ ID NO: 1427 - DNA, 19 bp, Artificial Sequence
  Detection oligonucleotide for ESR1
ggatcgttttaaatcgagt

SEQ ID NO: 1428 - DNA, 19 bp, Artificial Sequence
  Detection oligonucleotide for ESR1
ggattgttttaaattgagt

SEQ ID NO: 1429 - DNA, 18 bp, Artificial Sequence
  Detection oligonucleotide for ESR1
tggaggttcgggagttta

SEQ ID NO: 1430 - DNA, 18 bp, Artificial Sequence
  Detection oligonucleotide for ESR1
tggaggtttgggagttta

SEQ ID NO: 1431 - DNA, 19 bp, Artificial Sequence
  Detection oligonucleotide for ESR1
ttttatcggattcgtaggt

SEQ ID NO: 1432 - DNA, 19 bp, Artificial Sequence
  Detection oligonucleotide for ESR1
ttttattggatttgtaggt

SEQ ID NO: 1433 - DNA, 18 bp, Artificial Sequence
  Detection oligonucleotide for APAF1
agtaggacgtggtcgttt

SEQ ID NO: 1434 - DNA, 18 bp, Artificial Sequence
  Detection oligonucleotide for APAF1
agtaggatgtggttgttt

SEQ ID NO: 1435 - DNA, 18 bp, Artificial Sequence
  Detection oligonucleotide for APAF1
attcggcgggatttgatt

SEQ ID NO: 1436 - DNA, 18 bp, Artificial Sequence
  Detection oligonucleotide for APAF1
atttggtgggatttgatt

SEQ ID NO: 1437 - DNA, 18 bp, Artificial Sequence
  Detection oligonucleotide for APAF1
tagcgagtggacgtgatt

SEQ ID NO: 1438 - DNA, 18 bp, Artificial Sequence
  Detection oligonucleotide for APAF1
tagtgagtggatgtgatt

SEQ ID NO: 1439 - DNA, 18 bp, Artificial Sequence
  Detection oligonucleotide for HOXA5
agttagtcgggttttaag

SEQ ID NO: 1440 - DNA, 18 bp, Artificial Sequence
  Detection oligonucleotide for HOXA5
agttagttgggttttaag

SEQ ID NO: 1441 - DNA, 19 bp, Artificial Sequence
  Detection oligonucleotide for HOXA5
atatggttttcgtgttatt

SEQ ID NO: 1442 - DNA, 19 bp, Artificial Sequence
  Detection oligonucleotide for HOXA5
atatggtttttgtgttatt

SEQ ID NO: 1443 - DNA, 18 bp, Artificial Sequence
  Detection oligonucleotide for HOXA5
tttttgcgagcgtatgag

SEQ ID NO: 1444 - DNA, 18 bp, Artificial Sequence
  Detection oligonucleotide for HOXA5
tttttgtgagtgtatgag

SEQ ID NO: 1445 - DNA, 18 bp, Artificial Sequence
  Detection oligonucleotide for RASSF1
gtttcggggttcgtaata

SEQ ID NO: 1446 - DNA, 18 bp, Artificial Sequence
  Detection oligonucleotide for RASSF1
gttttggggtttgtaata

SEQ ID NO: 1447 - DNA, 18 bp, Artificial Sequence
  Detection oligonucleotide for RASSF1
aggtagttttcgagaatg

SEQ ID NO: 1448 - DNA, 18 bp, Artificial Sequence
  Detection oligonucleotide for RASSF1
aggtagtttttgagaatg

SEQ ID NO: 1449 - DNA, 18 bp, Artificial Sequence
  Detection oligonucleotide for RASSF1
tttgtgtcgtcgggaaat

SEQ ID NO: 1450 - DNA, 18 bp, Artificial Sequence
  Detection oligonucleotide for RASSF1
tttgtgttgttgggaaat

SEQ ID NO: 1451 - DNA, 20 bp, Artificial Sequence
  Detection oligonucleotide for RASSF1
ttagttttcgcgtagaatta

SEQ ID NO: 1452 - DNA, 20 bp, Artificial Sequence
  Detection oligonucleotide for RASSF1
ttagtttttgtgtagaatta

SEQ ID NO: 1453 - DNA, 18 bp, Artificial Sequence
  Detection oligonucleotide for RASSF1
tatttgcggagtcggtaa

SEQ ID NO: 1454 - DNA, 18 bp, Artificial Sequence
  Detection oligonucleotide for RASSF1
tatttgtggagttggtaa

SEQ ID NO: 1455 - DNA, 18 bp, Artificial Sequence
  Detection oligonucleotide for RASSF1
tttgtagcgggtggagta

SEQ ID NO: 1456 - DNA, 18 bp, Artificial Sequence
  Detection oligonucleotide for RASSF1
tttgtagtgggtggagta

SEQ ID NO: 1457 - DNA, 19 bp, Artificial Sequence
  Detection oligonucleotide for ABCB1
aaatgcgaatttcgagaaa

SEQ ID NO: 1458 - DNA, 19 bp, Artificial Sequence
  Detection oligonucleotide for ABCB1
aaatgtgaattttgagaaa

SEQ ID NO: 1459 - DNA, 19 bp, Artificial Sequence
  Detection oligonucleotide for ABCB1
ttcgtagtttttcgaggaa

SEQ ID NO: 1460 - DNA, 19 bp, Artificial Sequence
  Detection oligonucleotide for ABCB1
tttgtagttttttgaggaa

SEQ ID NO: 1461 - DNA, 18 bp, Artificial Sequence
  Detection oligonucleotide for ABCB1
tagttaattcgggtcggg

SEQ ID NO: 1462 - DNA, 18 bp, Artificial Sequence
  Detection oligonucleotide for ABCB1
tagttaatttgggttggg

SEQ ID NO: 1463 - DNA, 19 bp, Artificial Sequence
  Detection oligonucleotide for ABCB1
tgagtatagtcgtttcgtt

SEQ ID NO: 1464 - DNA, 19 bp, Artificial Sequence
  Detection oligonucleotide for ABCB1
tgagtatagttgttttgtt

SEQ ID NO: 1465 - DNA, 19 bp, Artificial Sequence
  Detection oligonucleotide for ABCB1
gtttattcgagtagcggtt

SEQ ID NO: 1466 - DNA, 19 bp, Artificial Sequence
  Detection oligonucleotide for ABCB1
gtttatttgagtagtggtt

SEQ ID NO: 1467 - DNA, 19 bp, Artificial Sequence
  Detection oligonucleotide for HLA-F
aatttttgcggttcgatag

SEQ ID NO: 1468 - DNA, 19 bp, Artificial Sequence
  Detection oligonucleotide for HLA-F
aatttttgtggtttgatag

SEQ ID NO: 1469 - DNA, 18 bp, Artificial Sequence
  Detection oligonucleotide for HLA-F
gggcgtaggttacgatta

SEQ ID NO: 1470 - DNA, 18 bp, Artificial Sequence
  Detection oligonucleotide for HLA-F
gggtgtaggttatgatta

SEQ ID NO: 1471 - DNA, 19 bp, Artificial Sequence
  Detection oligonucleotide for HLA-F
gagttttcggattcgaaat

SEQ ID NO: 1472 - DNA, 19 bp, Artificial Sequence
  Detection oligonucleotide for HLA-F
gagtttttggatttgaaat

SEQ ID NO: 1473 - DNA, 18 bp, Artificial Sequence
  Detection oligonucleotide for HLA-F
gaacgaggatttgcgttt

SEQ ID NO: 1474 - DNA, 18 bp, Artificial Sequence
  Detection oligonucleotide for HLA-F
gaatgaggatttgtgttt

SEQ ID NO: 1475 - DNA, 18 bp, Artificial Sequence
  Detection oligonucleotide for APOC2
attttaaggcgtgttagt

SEQ ID NO: 1476 - DNA, 18 bp, Artificial Sequence
  Detection oligonucleotide for APOC2
attttaaggtgtgttagt

SEQ ID NO: 1477 - DNA, 18 bp, Artificial Sequence
  Detection oligonucleotide for APOC2
tgtcggaggcgaattttt

SEQ ID NO: 1478 - DNA, 18 bp, Artificial Sequence
  Detection oligonucleotide for APOC2
tgttggaggtgaattttt

SEQ ID NO: 1479 - DNA, 18 bp, Artificial Sequence
  Detection oligonucleotide for APOC2
ttgggggacgttattgtt

SEQ ID NO: 1480 - DNA, 18 bp, Artificial Sequence
  Detection oligonucleotide for APOC2
ttgggggatgttattgtt

SEQ ID NO: 1481 - DNA, 18 bp, Artificial Sequence
  Detection oligonucleotide for APOC2
tgggtttgcggagaatgg

SEQ ID NO: 1482 - DNA, 18 bp, Artificial Sequence
  Detection oligonucleotide for APOC2
tgggtttgtggagaatgg

SEQ ID NO: 1483 - DNA, 19 bp, Artificial Sequence
  Detection oligonucleotide for CACNA1G
ggtcgagtcgataaagttt

SEQ ID NO: 1484 - DNA, 19 bp, Artificial Sequence
  Detection oligonucleotide for CACNA1G
ggttgagttgataaagttt

SEQ ID NO: 1485 - DNA, 20 bp, Artificial Sequence
  Detection oligonucleotide for CACNA1G
ttacgtgtttaagtacgaag

SEQ ID NO: 1486 - DNA, 20 bp, Artificial Sequence
  Detection oligonucleotide for CACNA1G
ttatgtgtttaagtatgaag

SEQ ID NO: 1487 - DNA, 18 bp, Artificial Sequence
  Detection oligonucleotide for CACNA1G
gaattgattcgggagtat

SEQ ID NO: 1488 - DNA, 18 bp, Artificial Sequence
  Detection oligonucleotide for CACNA1G
gaattgatttgggagtat

SEQ ID NO: 1489 - DNA, 18 bp, Artificial Sequence
  Detection oligonucleotide for CACNA1G
taggttcgtttagagttg

SEQ ID NO: 1490 - DNA, 18 bp, Artificial Sequence
  Detection oligonucleotide for CACNA1G
taggtttgtttagagttg

SEQ ID NO: 1491 - DNA, 18 bp, Artificial Sequence
  Detection oligonucleotide for EGR4
ggaagcgtatttatcgga

SEQ ID NO: 1492 - DNA, 18 bp, Artificial Sequence
  Detection oligonucleotide for EGR4
ggaagtgtatttattgga

SEQ ID NO: 1493 - DNA, 18 bp, Artificial Sequence
  Detection oligonucleotide for EGR4
aggcgtagcgttttagat

SEQ ID NO: 1494 - DNA, 18 bp, Artificial Sequence
  Detection oligonucleotide for EGR4
aggtgtagtgttttagat

SEQ ID NO: 1495 - DNA, 20 bp, Artificial Sequence
  Detection oligonucleotide for EGR4
taacgttatagttcgagttt

SEQ ID NO: 1496 - DNA, 20 bp, Artificial Sequence
  Detection oligonucleotide for EGR4
taatgttatagtttgagttt

SEQ ID NO: 1497 - DNA, 18 bp, Artificial Sequence
  Detection oligonucleotide for AR
agaggttgcgttttagag

SEQ ID NO: 1498 - DNA, 18 bp, Artificial Sequence
  Detection oligonucleotide for AR
agaggttgtgttttagag

SEQ ID NO: 1499 - DNA, 19 bp, Artificial Sequence
  Detection oligonucleotide for AR
ttatagtcgtagtcggttt

SEQ ID NO: 1500 - DNA, 19 bp, Artificial Sequence
  Detection oligonucleotide for AR
ttatagttgtagttggttt

SEQ ID NO: 1501 - DNA, 18 bp, Artificial Sequence
  Detection oligonucleotide for AR
ttatttcgagagaggttg

SEQ ID NO: 1502 - DNA, 18 bp, Artificial Sequence
  Detection oligonucleotide for AR
ttattttgagagaggttg

SEQ ID NO: 1503 - DNA, 18 bp, Artificial Sequence
  Detection oligonucleotide for AR
gtcgtggtcgttagtaag

SEQ ID NO: 1504 - DNA, 18 bp, Artificial Sequence
  Detection oligonucleotide for AR
gttgtggttgttagtaag

SEQ ID NO: 1505 - DNA, 18 bp, Artificial Sequence
  Detection oligonucleotide for AR
agtattttcggacgagga

SEQ ID NO: 1506 - DNA, 18 bp, Artificial Sequence
  Detection oligonucleotide for AR
agtatttttggatgagga

SEQ ID NO: 1507 - DNA, 19 bp, Artificial Sequence
  Detection oligonucleotide for RB1
tattagatttcgggatagg

SEQ ID NO: 1508 - DNA, 19 bp, Artificial Sequence
  Detection oligonucleotide for RB1
tattagattttgggatagg

SEQ ID NO: 1509 - DNA, 18 bp, Artificial Sequence
  Detection oligonucleotide for RB1
gtagaagtacgttcgggt

SEQ ID NO: 1510 - DNA, 18 bp, Artificial Sequence
  Detection oligonucleotide for RB1
gtagaagtatgtttgggt

SEQ ID NO: 1511 - DNA, 20 bp, Artificial Sequence
  Detection oligonucleotide for RB1
gtatcgattagcgttttagt

SEQ ID NO: 1512 - DNA, 20 bp, Artificial Sequence
  Detection oligonucleotide for RB1
gtattgattagtgttttagt

SEQ ID NO: 1513 - DNA, 19 bp, Artificial Sequence
  Detection oligonucleotide for RB1
aaaggcgttatgtcgttta

SEQ ID NO: 1514 - DNA, 19 bp, Artificial Sequence
  Detection oligonucleotide for RB1
aaaggtgttatgttgttta

SEQ ID NO: 1515 - DNA, 16 bp, Artificial Sequence
  Detection oligonucleotide for BRCA2
tataagttcgcgttgg

SEQ ID NO: 1516 - DNA, 18 bp, Artificial Sequence
  Detection oligonucleotide for BRCA2
ttataagtttgtgttggt

SEQ ID NO: 1517 - DNA, 16 bp, Artificial Sequence
  Detection oligonucleotide for BRCA2
tattcgaggcgtagta

SEQ ID NO: 1518 - DNA, 18 bp, Artificial Sequence
  Detection oligonucleotide for BRCA2
tatttgaggtgtagtaga

SEQ ID NO: 1519 - DNA, 18 bp, Artificial Sequence
  Detection oligonucleotide for BRCA2
tttatcgtcgtaaaagat

SEQ ID NO: 1520 - DNA, 20 bp, Artificial Sequence
  Detection oligonucleotide for BRCA2
gatttattgttgtaaaagat

SEQ ID NO: 1521 - DNA, 18 bp, Artificial Sequence
  Detection oligonucleotide for BRCA2
attcgttttagaggcgta

SEQ ID NO: 1522 - DNA, 18 bp, Artificial Sequence
  Detection oligonucleotide for BRCA2
atttgttttagaggtgta

SEQ ID NO: 1523 - DNA, 16 bp, Artificial Sequence
  Detection oligonucleotide for BRCA2
taagaagtcgcggtag

SEQ ID NO: 1524 - DNA, 17 bp, Artificial Sequence
  Detection oligonucleotide for BRCA2
gtaagaagttgtggtag

SEQ ID NO: 1525 - DNA, 16 bp, Artificial Sequence
  Detection oligonucleotide for CCND1
tgtcggcgtagtagta

SEQ ID NO: 1526 - DNA, 17 bp, Artificial Sequence
  Detection oligonucleotide for CCND1
tgttggtgtagtagtag

SEQ ID NO: 1527 - DNA, 16 bp, Artificial Sequence
  Detection oligonucleotide for CCND1
agaagcgagagtcgag

SEQ ID NO: 1528 - DNA, 17 bp, Artificial Sequence
  Detection oligonucleotide for CCND1
tagaagtgagagttgag

SEQ ID NO: 1529 - DNA, 16 bp, Artificial Sequence
  Detection oligonucleotide for CCND1
tttttaacgatcgggt

SEQ ID NO: 1530 - DNA, 17 bp, Artificial Sequence
  Detection oligonucleotide for CCND1
ttaatgattgggtgttg

SEQ ID NO: 1531 - DNA, 16 bp, Artificial Sequence
  Detection oligonucleotide for CCND1
tgtcgtttatgcggaa

SEQ ID NO: 1532 - DNA, 17 bp, Artificial Sequence
  Detection oligonucleotide for CCND1
tgttgtttatgtggaag

SEQ ID NO: 1533 - DNA, 16 bp, Artificial Sequence
  Detection oligonucleotide for CCND1
ggaagatcgtcgttat

SEQ ID NO: 1534 - DNA, 18 bp, Artificial Sequence
  Detection oligonucleotide for CCND1
agattgttgttatttgga

SEQ ID NO: 1535 - DNA, 18 bp, Artificial Sequence
  Detection oligonucleotide for EDNRB
gttttattcgagaaatgt

SEQ ID NO: 1536 - DNA, 19 bp, Artificial Sequence
  Detection oligonucleotide for EDNRB
tgttttatttgagaaatgt

SEQ ID NO: 1537 - DNA, 17 bp, Artificial Sequence
  Detection oligonucleotide for EDNRB
ggaatgttcgtgtttta

SEQ ID NO: 1538 - DNA, 18 bp, Artificial Sequence
  Detection oligonucleotide for EDNRB
ggaatgtttgtgttttat

SEQ ID NO: 1539 - DNA, 17 bp, Artificial Sequence
  Detection oligonucleotide for EDNRB
taggggtcgatttttaa

SEQ ID NO: 1540 - DNA, 18 bp, Artificial Sequence
  Detection oligonucleotide for EDNRB
ttaggggttgatttttaa

SEQ ID NO: 1541 - DNA, 19 bp, Artificial Sequence
  Detection oligonucleotide for EDNRB
aatataatcggttaggtta

SEQ ID NO: 1542 - DNA, 20 bp, Artificial Sequence
  Detection oligonucleotide for EDNRB
gataatataattggttaggt

SEQ ID NO: 1543 - DNA, 16 bp, Artificial Sequence
  Detection oligonucleotide for EGFR
aagttttcgcgagttt

SEQ ID NO: 1544 - DNA, 18 bp, Artificial Sequence
  Detection oligonucleotide for EGFR
aaagtttttgtgagtttt

SEQ ID NO: 1545 - DNA, 17 bp, Artificial Sequence
  Detection oligonucleotide for EGFR
gtattatttcggacgtt

SEQ ID NO: 1546 - DNA, 18 bp, Artificial Sequence
  Detection oligonucleotide for EGFR
tattttggatgtttggta

SEQ ID NO: 1547 - DNA, 18 bp, Artificial Sequence
  Detection oligonucleotide for EGFR
tttcgagagggtttcgta

SEQ ID NO: 1548 - DNA, 18 bp, Artificial Sequence
  Detection oligonucleotide for EGFR
ttttgagagggttttgta

SEQ ID NO: 1549 - DNA, 16 bp, Artificial Sequence
  Detection oligonucleotide for EGFR
attattcgacgttggt

SEQ ID NO: 1550 - DNA, 19 bp, Artificial Sequence
  Detection oligonucleotide for EGFR
ttattatttgatgttggtt

SEQ ID NO: 1551 - DNA, 16 bp, Artificial Sequence
  Detection oligonucleotide for EGFR
gtaagttcgcggggat

SEQ ID NO: 1552 - DNA, 16 bp, Artificial Sequence
  Detection oligonucleotide for EGFR
gtaagtttgtggggat

SEQ ID NO: 1553 - DNA, 16 bp, Artificial Sequence
  Detection oligonucleotide for ERBB2
agatcgcgttattgtt

SEQ ID NO: 1554 - DNA, 18 bp, Artificial Sequence
  Detection oligonucleotide for ERBB2
agagattgtgttattgtt

SEQ ID NO: 1555 - DNA, 18 bp, Artificial Sequence
  Detection oligonucleotide for ERBB2
atttcggatttcggggga

SEQ ID NO: 1556 - DNA, 20 bp, Artificial Sequence
  Detection oligonucleotide for ERBB2
aatttattttggattttggg

SEQ ID NO: 1557 - DNA, 17 bp, Artificial Sequence
  Detection oligonucleotide for ERBB2
ggatttttcgaggaaaa

SEQ ID NO: 1558 - DNA, 17 bp, Artificial Sequence
  Detection oligonucleotide for ERBB2
gggattttttgaggaaa

SEQ ID NO: 1559 - DNA, 16 bp, Artificial Sequence
  Detection oligonucleotide for ERBB2
taggtttgcgcgaaga

SEQ ID NO: 1560 - DNA, 16 bp, Artificial Sequence
  Detection oligonucleotide for ERBB2
tttgtgtgaagagagg

SEQ ID NO: 1561 - DNA, 16 bp, Artificial Sequence
  Detection oligonucleotide for FOS
tttcgggttcgagtaa

SEQ ID NO: 1562 - DNA, 18 bp, Artificial Sequence
  Detection oligonucleotide for FOS
ttttgggtttgagtaata

SEQ ID NO: 1563 - DNA, 17 bp, Artificial Sequence
  Detection oligonucleotide for FOS
tttcgaaggaatgcgtt

SEQ ID NO: 1564 - DNA, 17 bp, Artificial Sequence
  Detection oligonucleotide for FOS
ttttgaaggaatgtgtt

SEQ ID NO: 1565 - DNA, 16 bp, Artificial Sequence
  Detection oligonucleotide for FOS
agaaacggtatcgagt

SEQ ID NO: 1566 - DNA, 17 bp, Artificial Sequence
  Detection oligonucleotide for FOS
ggagaaatggtattgag

SEQ ID NO: 1567 - DNA, 18 bp, Artificial Sequence
  Detection oligonucleotide for FOS
aattgttcgcgggttgta

SEQ ID NO: 1568 - DNA, 18 bp, Artificial Sequence
  Detection oligonucleotide for FOS
aattgtttgtgggttgta

SEQ ID NO: 1569 - DNA, 17 bp, Artificial Sequence
  Detection oligonucleotide for NFKB1
tataggcgttcgttatt

SEQ ID NO: 1570 - DNA, 18 bp, Artificial Sequence
  Detection oligonucleotide for NFKB1
ggattataggtgtttgtt

SEQ ID NO: 1571 - DNA, 18 bp, Artificial Sequence
  Detection oligonucleotide for NFKB1
tattacgttcggttaatt

SEQ ID NO: 1572 - DNA, 20 bp, Artificial Sequence
  Detection oligonucleotide for NFKB1
attatgtttggttaattttt

SEQ ID NO: 1573 - DNA, 17 bp, Artificial Sequence
  Detection oligonucleotide for NFKB1
agttatcgtattcggtt

SEQ ID NO: 1574 - DNA, 18 bp, Artificial Sequence
  Detection oligonucleotide for NFKB1
tgagttattgtatttggt

SEQ ID NO: 1575 - DNA, 18 bp, Artificial Sequence
  Detection oligonucleotide for NFKB1
tttagtttttcggagtta

SEQ ID NO: 1576 - DNA, 19 bp, Artificial Sequence
  Detection oligonucleotide for NFKB1
ttagttttttggagttaaa

SEQ ID NO: 1577 - DNA, 16 bp, Artificial Sequence
  Detection oligonucleotide for NFKB1
aaaggtcgattgttgg

SEQ ID NO: 1578 - DNA, 17 bp, Artificial Sequence
  Detection oligonucleotide for NFKB1
taaaggttgattgttgg

SEQ ID NO: 1579 - DNA, 16 bp, Artificial Sequence
  Detection oligonucleotide for X51730 PGR
tatcgagaggttcgat

SEQ ID NO: 1580 - DNA, 18 bp, Artificial Sequence
  Detection oligonucleotide for X51730 PGR
tgtattgagaggtttgat

SEQ ID NO: 1581 - DNA, 16 bp, Artificial Sequence
  Detection oligonucleotide for X51730 PGR
gagtcgcgtgttatta

SEQ ID NO: 1582 - DNA, 16 bp, Artificial Sequence
  Detection oligonucleotide for X51730 PGR
aaaggagttgtgtgtt

SEQ ID NO: 1583 - DNA, 16 bp, Artificial Sequence
  Detection oligonucleotide for X51730 PGR
aaattgtcgtcgtagt

SEQ ID NO: 1584 - DNA, 19 bp, Artificial Sequence
  Detection oligonucleotide for X51730 PGR
attaaattgttgttgtagt

SEQ ID NO: 1585 - DNA, 18 bp, Artificial Sequence
  Detection oligonucleotide for X51730 PGR
tgtcgttcgttgggataa

SEQ ID NO: 1586 - DNA, 18 bp, Artificial Sequence
  Detection oligonucleotide for X51730 PGR
tgttgtttgttgggataa

SEQ ID NO: 1587 - DNA, 16 bp, Artificial Sequence
  Detection oligonucleotide for TP53
gaaaatcgttggggtt

SEQ ID NO: 1588 - DNA, 16 bp, Artificial Sequence
  Detection oligonucleotide for TP53
ggaaaattgttggggt

SEQ ID NO: 1589 - DNA, 17 bp, Artificial Sequence
  Detection oligonucleotide for TP53
agtcggtttaaagcgta

SEQ ID NO: 1590 - DNA, 18 bp, Artificial Sequence
  Detection oligonucleotide for TP53
agttggtttaaagtgtat

SEQ ID NO: 1591 - DNA, 19 bp, Artificial Sequence
  Detection oligonucleotide for TP53
agttttcggtttcgttaga

SEQ ID NO: 1592 - DNA, 19 bp, Artificial Sequence
  Detection oligonucleotide for TP53
agtttttggttttgttaga

SEQ ID NO: 1593 - DNA, 16 bp, Artificial Sequence
  Detection oligonucleotide for TP73
gtgcgagttagtcgga

SEQ ID NO: 1594 - DNA, 16 bp, Artificial Sequence
  Detection oligonucleotide for TP73
gtgtgagttagttgga

SEQ ID NO: 1595 - DNA, 16 bp, Artificial Sequence
  Detection oligonucleotide for TP73
tatcggttcggagtta

SEQ ID NO: 1596 - DNA, 17 bp, Artificial Sequence
  Detection oligonucleotide for TP73
aggatattggtttggag

SEQ ID NO: 1597 - DNA, 16 bp, Artificial Sequence
  Detection oligonucleotide for TP73
agagtcgttcggaatt

SEQ ID NO: 1598 - DNA, 17 bp, Artificial Sequence
  Detection oligonucleotide for TP73
tgagagttgtttggaat

SEQ ID NO: 1599 - DNA, 18 bp, Artificial Sequence
  Detection oligonucleotide for ESR1
ttttcgcgtttattttaa

SEQ ID NO: 1600 - DNA, 21 bp, Artificial Sequence
  Detection oligonucleotide for ESR1
ttttttgtgtttattttaagt

SEQ ID NO: 1601 - DNA, 18 bp, Artificial Sequence
  Detection oligonucleotide for ESR1
agtagattttcgtgcgtt

SEQ ID NO: 1602 - DNA, 18 bp, Artificial Sequence
  Detection oligonucleotide for ESR1
agtagatttttgtgtgtt

SEQ ID NO: 1603 - DNA, 16 bp, Artificial Sequence
  Detection oligonucleotide for ESR1
agtagcgacgataagt

SEQ ID NO: 1604 - DNA, 19 bp, Artificial Sequence
  Detection oligonucleotide for ESR1
tttagtagtgatgataagt

SEQ ID NO: 1605 - DNA, 18 bp, Artificial Sequence
  Detection oligonucleotide for ESR1
gatcgttttaaatcgagt

SEQ ID NO: 1606 - DNA, 19 bp, Artificial Sequence
  Detection oligonucleotide for ESR1
ggattgttttaaattgagt

SEQ ID NO: 1607 - DNA, 16 bp, Artificial Sequence
  Detection oligonucleotide for ESR1
tatcggattcgtaggt

SEQ ID NO: 1608 - DNA, 19 bp, Artificial Sequence
  Detection oligonucleotide for ESR1
tttattggatttgtaggtt

SEQ ID NO: 1609 - DNA, 17 bp, Artificial Sequence
  Detection oligonucleotide for SERPINE1
agtcgtgtattatcgga

SEQ ID NO: 1610 - DNA, 18 bp, Artificial Sequence
  Detection oligonucleotide for SERPINE1
agttgtgtattattggag

SEQ ID NO: 1611 - DNA, 16 bp, Artificial Sequence
  Detection oligonucleotide for SERPINE1
aggcggtcgggtatat

SEQ ID NO: 1612 - DNA, 16 bp, Artificial Sequence
  Detection oligonucleotide for SERPINE1
aggtggttgggtatat

SEQ ID NO: 1613 - DNA, 16 bp, Artificial Sequence
  Detection oligonucleotide for SERPINE1
tagagtatcgggtgga

SEQ ID NO: 1614 - DNA, 16 bp, Artificial Sequence
  Detection oligonucleotide for SERPINE1
agagtattgggtggat

SEQ ID NO: 1615 - DNA, 16 bp, Artificial Sequence
  Detection oligonucleotide for SERPINE1
aggatattcgggagag

SEQ ID NO: 1616 - DNA, 17 bp, Artificial Sequence
  Detection oligonucleotide for SERPINE1
aggatatttgggagaga

SEQ ID NO: 1617 - DNA, 18 bp, Artificial Sequence
  Detection oligonucleotide for CALM1
tggcgttcgttttattaa

SEQ ID NO: 1618 - DNA, 19 bp, Artificial Sequence
  Detection oligonucleotide for CALM1
tggtgtttgttttattaaa

SEQ ID NO: 1619 - DNA, 19 bp, Artificial Sequence
  Detection oligonucleotide for CALM1
agtagtattcgagttaaat

SEQ ID NO: 1620 - DNA, 20 bp, Artificial Sequence
  Detection oligonucleotide for CALM1
agtagtatttgagttaaatt

SEQ ID NO: 1621 - DNA, 16 bp, Artificial Sequence
  Detection oligonucleotide for CALM1
tagaggacgaggtagt

SEQ ID NO: 1622 - DNA, 17 bp, Artificial Sequence
  Detection oligonucleotide for CALM1
tagaggatgaggtagtt

SEQ ID NO: 1623 - DNA, 16 bp, Artificial Sequence
  Detection oligonucleotide for CALM1
ttagttgtcgaggaga

SEQ ID NO: 1624 - DNA, 17 bp, Artificial Sequence
  Detection oligonucleotide for CALM1
tttagttgttgaggaga

SEQ ID NO: 1625 - DNA, 18 bp, Artificial Sequence
  Detection oligonucleotide for CSNK2B
tgattttcgaattttggt

SEQ ID NO: 1626 - DNA, 18 bp, Artificial Sequence
  Detection oligonucleotide for CSNK2B
tgatttttgaattttggt

SEQ ID NO: 1627 - DNA, 17 bp, Artificial Sequence
  Detection oligonucleotide for CSNK2B
gaacgttttagtgcgtt

SEQ ID NO: 1628 - DNA, 18 bp, Artificial Sequence
  Detection oligonucleotide for CSNK2B
ggaatgttttagtgtgtt

SEQ ID NO: 1629 - DNA, 18 bp, Artificial Sequence
  Detection oligonucleotide for CSNK2B
gtgcgaattagtttcgtt

SEQ ID NO: 1630 - DNA, 18 bp, Artificial Sequence
  Detection oligonucleotide for CSNK2B
gtgtgaattagttttgtt

SEQ ID NO: 1631 - DNA, 18 bp, Artificial Sequence
  Detection oligonucleotide for CSNK2B
attttcggttaattcgtt

SEQ ID NO: 1632 - DNA, 19 bp, Artificial Sequence
  Detection oligonucleotide for CSNK2B
atttttggttaatttgttg

SEQ ID NO: 1633 - DNA, 16 bp, Artificial Sequence
  Detection oligonucleotide for FGFR1
tatgtttcggggaagt

SEQ ID NO: 1634 - DNA, 17 bp, Artificial Sequence
  Detection oligonucleotide for FGFR1
tatgttttggggaagta

SEQ ID NO: 1635 - DNA, 19 bp, Artificial Sequence
  Detection oligonucleotide for FGFR1
tatgattcgttttttaaga

SEQ ID NO: 1636 - DNA, 20 bp, Artificial Sequence
  Detection oligonucleotide for FGFR1
agttatgatttgttttttaa

SEQ ID NO: 1637 - DNA, 16 bp, Artificial Sequence
  Detection oligonucleotide for MKI67
ttgagatcgcgttatt

SEQ ID NO: 1638 - DNA, 18 bp, Artificial Sequence
  Detection oligonucleotide for MKI67
agttgagattgtgttatt

SEQ ID NO: 1639 - DNA, 18 bp, Artificial Sequence
  Detection oligonucleotide for MKI67
aggatcgtttgagtcggg

SEQ ID NO: 1640 - DNA, 18 bp, Artificial Sequence
  Detection oligonucleotide for MKI67
aggattgtttgagttggg

SEQ ID NO: 1641 - DNA, 16 bp, Artificial Sequence
  Detection oligonucleotide for MKI67
aaattcgttaggcgtg

SEQ ID NO: 1642 - DNA, 17 bp, Artificial Sequence
  Detection oligonucleotide for MKI67
aatttgttaggtgtggt

SEQ ID NO: 1643 - DNA, 16 bp, Artificial Sequence
  Detection oligonucleotide for MKI67
tgagttcgggagttta

SEQ ID NO: 1644 - DNA, 17 bp, Artificial Sequence
  Detection oligonucleotide for MKI67
ttgagtttgggagttta

SEQ ID NO: 1645 - DNA, 19 bp, Artificial Sequence
  Detection oligonucleotide for NPM1
agtagtattcgtttatttt

SEQ ID NO: 1646 - DNA, 20 bp, Artificial Sequence
  Detection oligonucleotide for NPM1
gagtagtatttgtttatttt

SEQ ID NO: 1647 - DNA, 17 bp, Artificial Sequence
  Detection oligonucleotide for NPM1
atttaagtgcgtgttgt

SEQ ID NO: 1648 - DNA, 17 bp, Artificial Sequence
  Detection oligonucleotide for NPM1
atttaagtgtgtgttgt

SEQ ID NO: 1649 - DNA, 17 bp, Artificial Sequence
  Detection oligonucleotide for NPM1
gtttttcgatggaagat

SEQ ID NO: 1650 - DNA, 18 bp, Artificial Sequence
  Detection oligonucleotide for NPM1
tgttttttgatggaagat

SEQ ID NO: 1651 - DNA, 16 bp, Artificial Sequence
  Detection oligonucleotide for NPM1
tgatggacgtggatat

SEQ ID NO: 1652 - DNA, 17 bp, Artificial Sequence
  Detection oligonucleotide for NPM1
ttgatggatgtggatat

SEQ ID NO: 1653 - DNA, 17 bp, Artificial Sequence
  Detection oligonucleotide for MAPK1
agttttacgtttcgatt

SEQ ID NO: 1654 - DNA, 19 bp, Artificial Sequence
  Detection oligonucleotide for MAPK1
tgtagttttatgttttgat

SEQ ID NO: 1655 - DNA, 17 bp, Artificial Sequence
  Detection oligonucleotide for MAPK1
aagaaacgatcgaattt

SEQ ID NO: 1656 - DNA, 18 bp, Artificial Sequence
  Detection oligonucleotide for MAPK1
aaatgattgaatttggga

SEQ ID NO: 1657 - DNA, 19 bp, Artificial Sequence
  Detection oligonucleotide for MAPK1
atttatttttcgtgtgtat

SEQ ID NO: 1658 - DNA, 20 bp, Artificial Sequence
  Detection oligonucleotide for MAPK1
aatttattttttgtgtgtat

SEQ ID NO: 1659 - DNA, 18 bp, Artificial Sequence
  Detection oligonucleotide for MAPK1
gtgtatcgtgtttttaat

SEQ ID NO: 1660 - DNA, 19 bp, Artificial Sequence
  Detection oligonucleotide for MAPK1
tgtgtattgtgtttttaat

SEQ ID NO: 1661 - DNA, 16 bp, Artificial Sequence
  Detection oligonucleotide for TK2
aagtttcgagtgtgat

SEQ ID NO: 1662 - DNA, 17 bp, Artificial Sequence
  Detection oligonucleotide for TK2
aagttttgagtgtgatg

SEQ ID NO: 1663 - DNA, 16 bp, Artificial Sequence
  Detection oligonucleotide for TK2
ttaagacggtggagat

SEQ ID NO: 1664 - DNA, 17 bp, Artificial Sequence
  Detection oligonucleotide for TK2
ttttaagatggtggaga

SEQ ID NO: 1665 - DNA, 16 bp, Artificial Sequence
  Detection oligonucleotide for TK2
gaattacggtgatggt

SEQ ID NO: 1666 - DNA, 18 bp, Artificial Sequence
  Detection oligonucleotide for TK2
gaatgaattatggtgatg

SEQ ID NO: 1667 - DNA, 18 bp, Artificial Sequence
  Detection oligonucleotide for TK2
aggtaattgtcgattaga

SEQ ID NO: 1668 - DNA, 19 bp, Artificial Sequence
  Detection oligonucleotide for TK2
aggtaattgttgattagat

SEQ ID NO: 1669 - DNA, 18 bp, Artificial Sequence
  Detection oligonucleotide for TK2
gtgtgtttttcgtaaata

SEQ ID NO: 1670 - DNA, 19 bp, Artificial Sequence
  Detection oligonucleotide for TK2
gtgtgttttttgtaaataa

SEQ ID NO: 1671 - DNA, 16 bp, Artificial Sequence
  Detection oligonucleotide for HSPB1
gtgttacggtagggta

SEQ ID NO: 1672 - DNA, 17 bp, Artificial Sequence
  Detection oligonucleotide for HSPB1
gtgttatggtagggtat

SEQ ID NO: 1673 - DNA, 16 bp, Artificial Sequence
  Detection oligonucleotide for HSPB1
agtcgtgttacggtag

SEQ ID NO: 1674 - DNA, 17 bp, Artificial Sequence
  Detection oligonucleotide for HSPB1
agttgtgttatggtagg

SEQ ID NO: 1675 - DNA, 18 bp, Artificial Sequence
  Detection oligonucleotide for HSPB1
ttttttcgttaaggaaag

SEQ ID NO: 1676 - DNA, 19 bp, Artificial Sequence
  Detection oligonucleotide for HSPB1
ttttttttgttaaggaaag

SEQ ID NO: 1677 - DNA, 16 bp, Artificial Sequence
  Detection oligonucleotide for TES
tagaagtcggttcgtg

SEQ ID NO: 1678 - DNA, 16 bp, Artificial Sequence
  Detection oligonucleotide for TES
agaagttggtttgtgg

SEQ ID NO: 1679 - DNA, 17 bp, Artificial Sequence
  Detection oligonucleotide for TES
gttcgtggacgtttaga

SEQ ID NO: 1680 - DNA, 17 bp, Artificial Sequence
  Detection oligonucleotide for TES
gtttgtggatgtttaga

SEQ ID NO: 1681 - DNA, 16 bp, Artificial Sequence
  Detection oligonucleotide for TES
gattgggcggcggaag

SEQ ID NO: 1682 - DNA, 16 bp, Artificial Sequence
  Detection oligonucleotide for TES
attgggtggtggaagt

SEQ ID NO: 1683 - DNA, 16 bp, Artificial Sequence
  Detection oligonucleotide for TES
tagcggagtcggaggt

SEQ ID NO: 1684 - DNA, 16 bp, Artificial Sequence
  Detection oligonucleotide for TES
tagtggagttggaggt

SEQ ID NO: 1685 - DNA, 16 bp, Artificial Sequence
  Detection oligonucleotide for TES
aattcggtcgtgggat

SEQ ID NO: 1686 - DNA, 16 bp, Artificial Sequence
  Detection oligonucleotide for TES
aatttggttgtgggat

SEQ ID NO: 1687 - DNA, 16 bp, Artificial Sequence
  Detection oligonucleotide for SDC4
ttgcgggttatacgat

SEQ ID NO: 1688 - DNA, 18 bp, Artificial Sequence
  Detection oligonucleotide for SDC4
tttgtgggttatatgatt

SEQ ID NO: 1689 - DNA, 17 bp, Artificial Sequence
  Detection oligonucleotide for SDC4
gtgaatcgtgttaagat

SEQ ID NO: 1690 - DNA, 18 bp, Artificial Sequence
  Detection oligonucleotide for SDC4
tgtgaattgtgttaagat

SEQ ID NO: 1691 - DNA, 16 bp, Artificial Sequence
  Detection oligonucleotide for PITX2
atgttagcgggtcgaa

SEQ ID NO: 1692 - DNA, 16 bp, Artificial Sequence
  Detection oligonucleotide for PITX2
tagtgggttgaagagt

SEQ ID NO: 1693 - DNA, 16 bp, Artificial Sequence
  Detection oligonucleotide for GPR37
tttcgatagcgtttga

SEQ ID NO: 1694 - DNA, 19 bp, Artificial Sequence
  Detection oligonucleotide for GPR37
ttttgatagtgtttgattt

SEQ ID NO: 1695 - DNA, 16 bp, Artificial Sequence
  Detection oligonucleotide for GPR37
atagcggaagatcggt

SEQ ID NO: 1696 - DNA, 17 bp, Artificial Sequence
  Detection oligonucleotide for GPR37
atagtggaagattggtt

SEQ ID NO: 1697 - DNA, 16 bp, Artificial Sequence
  Detection oligonucleotide for GPR37
tagcggggaatcggag

SEQ ID NO: 1698 - DNA, 16 bp, Artificial Sequence
  Detection oligonucleotide for GPR37
tagtggggaattggag

SEQ ID NO: 1699 - DNA, 19 bp, Artificial Sequence
  Detection oligonucleotide for GPR37
atttattttcgttcgggta

SEQ ID NO: 1700 - DNA, 19 bp, Artificial Sequence
  Detection oligonucleotide for GPR37
atttatttttgtttgggta

SEQ ID NO: 1701 - DNA, 16 bp, Artificial Sequence
  Detection oligonucleotide for GPR37
attcggtagtcgtagt

SEQ ID NO: 1702 - DNA, 18 bp, Artificial Sequence
  Detection oligonucleotide for GPR37
atttggtagttgtagttt

SEQ ID NO: 1703 - DNA, 16 bp, Artificial Sequence
  Detection oligonucleotide for FGF1
tataggttcgcggatt

SEQ ID NO: 1704 - DNA, 18 bp, Artificial Sequence
  Detection oligonucleotide for FGF1
ttataggtttgtggattg

SEQ ID NO: 1705 - DNA, 18 bp, Artificial Sequence
  Detection oligonucleotide for FGF1
attattcgggaattttgt

SEQ ID NO: 1706 - DNA, 19 bp, Artificial Sequence
  Detection oligonucleotide for FGF1
tattatttgggaattttgt

SEQ ID NO: 1707 - DNA, 17 bp, Artificial Sequence
  Detection oligonucleotide for FGF1
agttttgatcgagaagt

SEQ ID NO: 1708 - DNA, 18 bp, Artificial Sequence
  Detection oligonucleotide for FGF1
tagttttgattgagaagt

SEQ ID NO: 1709 - DNA, 16 bp, Artificial Sequence
  Detection oligonucleotide for FGF1
tagtaacgggggttat

SEQ ID NO: 1710 - DNA, 16 bp, Artificial Sequence
  Detection oligonucleotide for FGF1
tgtagtaatgggggtt

SEQ ID NO: 1711 - DNA, 17 bp, Artificial Sequence
  Detection oligonucleotide for FGF1
gattttttcggatggta

SEQ ID NO: 1712 - DNA, 19 bp, Artificial Sequence
  Detection oligonucleotide for FGF1
atttttttggatggtatag

SEQ ID NO: 1713 - DNA, 17 bp, Artificial Sequence
  Detection oligonucleotide for CTSB
tgggatattcgaggaat

SEQ ID NO: 1714 - DNA, 18 bp, Artificial Sequence
  Detection oligonucleotide for CTSB
ggatatttgaggaattga

SEQ ID NO: 1715 - DNA, 17 bp, Artificial Sequence
  Detection oligonucleotide for CTSB
tgatatgcgttatggtt

SEQ ID NO: 1716 - DNA, 18 bp, Artificial Sequence
  Detection oligonucleotide for CTSB
ttgatatgtgttatggtt

SEQ ID NO: 1717 - DNA, 16 bp, Artificial Sequence
  Detection oligonucleotide for CTSD
tagagggcgagcggta

SEQ ID NO: 1718 - DNA, 16 bp, Artificial Sequence
  Detection oligonucleotide for CTSD
tagagggtgagtggta

SEQ ID NO: 1719 - DNA, 16 bp, Artificial Sequence
  Detection oligonucleotide for CTSD
ggagcgcgaaagttat

SEQ ID NO: 1720 - DNA, 16 bp, Artificial Sequence
  Detection oligonucleotide for CTSD
taggggagtgtgaaag

SEQ ID NO: 1721 - DNA, 16 bp, Artificial Sequence
  Detection oligonucleotide for CTSD
taggaggtcgcgtagg

SEQ ID NO: 1722 - DNA, 16 bp, Artificial Sequence
  Detection oligonucleotide for CTSD
taggaggttgtgtagg

SEQ ID NO: 1723 - DNA, 17 bp, Artificial Sequence
  Detection oligonucleotide for CTSD
attcgtttagattcggg

SEQ ID NO: 1724 - DNA, 18 bp, Artificial Sequence
  Detection oligonucleotide for CTSD
atttgtttagatttgggg

SEQ ID NO: 1725 - DNA, 15 bp, Artificial Sequence
  Detection oligonucleotide for PLAUR
ggtatagcgggaagt

SEQ ID NO: 1726 - DNA, 17 bp, Artificial Sequence
  Detection oligonucleotide for PLAUR
ggtatagtgggaagtaa

SEQ ID NO: 1727 - DNA, 21 bp, Artificial Sequence
  Detection oligonucleotide for PLAUR
atttatatttatcgttaaagt

SEQ ID NO: 1728 - DNA, 22 bp, Artificial Sequence
  Detection oligonucleotide for PLAUR
tatatttattgttaaagttttt

SEQ ID NO: 1729 - DNA, 17 bp, Artificial Sequence
  Detection oligonucleotide for PLAUR
agagcgattgtttcggg

SEQ ID NO: 1730 - DNA, 17 bp, Artificial Sequence
  Detection oligonucleotide for PLAUR
agagtgattgttttggg

SEQ ID NO: 1731 - DNA, 16 bp, Artificial Sequence
  Detection oligonucleotide for PLAUR
gggttttacgttagga

SEQ ID NO: 1732 - DNA, 17 bp, Artificial Sequence
  Detection oligonucleotide for PLAUR
gggttttatgttaggaa

SEQ ID NO: 1733 - DNA, 20 bp, Artificial Sequence
  Detection oligonucleotide for CGA
atatttattttcggaaattt

SEQ ID NO: 1734 - DNA, 21 bp, Artificial Sequence
  Detection oligonucleotide for CGA
ttatttttggaaatttatagt

SEQ ID NO: 1735 - DNA, 19 bp, Artificial Sequence
  Detection oligonucleotide for CGA
tgattttgtcgttattatt

SEQ ID NO: 1736 - DNA, 20 bp, Artificial Sequence
  Detection oligonucleotide for CGA
ttgattttgttgttattatt

SEQ ID NO: 1737 - DNA, 16 bp, Artificial Sequence
  Detection oligonucleotide for CYP2D6
tagagggcgaaggtta

SEQ ID NO: 1738 - DNA, 16 bp, Artificial Sequence
  Detection oligonucleotide for CYP2D6
agagggtgaaggttat

SEQ ID NO: 1739 - DNA, 18 bp, Artificial Sequence
  Detection oligonucleotide for CYP2D6
tgtatcggtattaacgtt

SEQ ID NO: 1740 - DNA, 19 bp, Artificial Sequence
  Detection oligonucleotide for CYP2D6
tgtattggtattaatgttg

SEQ ID NO: 1741 - DNA, 17 bp, Artificial Sequence
  Detection oligonucleotide for CYP2D6
gtacgttattcgttagg

SEQ ID NO: 1742 - DNA, 19 bp, Artificial Sequence
  Detection oligonucleotide for CYP2D6
tgtatgttatttgttaggt

SEQ ID NO: 1743 - DNA, 18 bp, Artificial Sequence
  Detection oligonucleotide for CYP3A4
aaaagagtcgtatagaga

SEQ ID NO: 1744 - DNA, 18 bp, Artificial Sequence
  Detection oligonucleotide for CYP3A4
aagagttgtatagagagg

SEQ ID NO: 1745 - DNA, 17 bp, Artificial Sequence
  Detection oligonucleotide for CYP3A4
gtgtgtcgggagttata

SEQ ID NO: 1746 - DNA, 17 bp, Artificial Sequence
  Detection oligonucleotide for CYP3A4
gtgtgttgggagttata

SEQ ID NO: 1747 - DNA, 17 bp, Artificial Sequence
  Detection oligonucleotide for CYP3A4
aaataggcgatgtttaa

SEQ ID NO: 1748 - DNA, 18 bp, Artificial Sequence
  Detection oligonucleotide for CYP3A4
tagaaataggtgatgttt

SEQ ID NO: 1749 - DNA, 20 bp, Artificial Sequence
  Detection oligonucleotide for CYP3A4
taaaattatagcgtttttaa

SEQ ID NO: 1750 - DNA, 21 bp, Artificial Sequence
  Detection oligonucleotide for CYP3A4
aaattatagtgtttttaaaat

SEQ ID NO: 1751 - DNA, 16 bp, Artificial Sequence
  Detection oligonucleotide for TK1
aggaattcggtacgtg

SEQ ID NO: 1752 - DNA, 17 bp, Artificial Sequence
  Detection oligonucleotide for TK1
gaggaatttggtatgtg

SEQ ID NO: 1753 - DNA, 16 bp, Artificial Sequence
  Detection oligonucleotide for TK1
aattacgagtcggttt

SEQ ID NO: 1754 - DNA, 18 bp, Artificial Sequence
  Detection oligonucleotide for TK1
ggttaattatgagttggt

SEQ ID NO: 1755 - DNA, 16 bp, Artificial Sequence
  Detection oligonucleotide for TK1
aggtcgtttcgtagta

SEQ ID NO: 1756 - DNA, 18 bp, Artificial Sequence
  Detection oligonucleotide for TK1
ttaaggttgttttgtagt

SEQ ID NO: 1757 - DNA, 18 bp, Artificial Sequence
  Detection oligonucleotide for TK1
tttcgggaagtttacgaa

SEQ ID NO: 1758 - DNA, 18 bp, Artificial Sequence
  Detection oligonucleotide for TK1
ttttgggaagtttatgaa

SEQ ID NO: 1759 - DNA, 19 bp, Artificial Sequence
  Detection oligonucleotide for RENBP
tagatttttcggttatttt

SEQ ID NO: 1760 - DNA, 20 bp, Artificial Sequence
  Detection oligonucleotide for RENBP
tttagattttttggttattt

SEQ ID NO: 1761 - DNA, 16 bp, Artificial Sequence
  Detection oligonucleotide for RENBP
ggtttattcgagtgga

SEQ ID NO: 1762 - DNA, 17 bp, Artificial Sequence
  Detection oligonucleotide for RENBP
tggtttatttgagtgga

SEQ ID NO: 1763 - DNA, 18 bp, Artificial Sequence
  Detection oligonucleotide for RENBP
taaagtttcgttttaggt

SEQ ID NO: 1764 - DNA, 19 bp, Artificial Sequence
  Detection oligonucleotide for RENBP
ttaaagttttgttttaggt

SEQ ID NO: 1765 - DNA, 16 bp, Artificial Sequence
  Detection oligonucleotide for RENBP
gggatcgcgattaatt

SEQ ID NO: 1766 - DNA, 19 bp, Artificial Sequence
  Detection oligonucleotide for RENBP
gggattgtgattaattttg

SEQ ID NO: 1767 - DNA, 16 bp, Artificial Sequence
  Detection oligonucleotide for F12
tggattaacggacgga

SEQ ID NO: 1768 - DNA, 17 bp, Artificial Sequence
  Detection oligonucleotide for F12
ttggattaatggatgga

SEQ ID NO: 1769 - DNA, 16 bp, Artificial Sequence
  Detection oligonucleotide for F12
ggacggacgttatgag

SEQ ID NO: 1770 - DNA, 17 bp, Artificial Sequence
  Detection oligonucleotide for F12
ggatggatgttatgagg

SEQ ID NO: 1771 - DNA, 17 bp, Artificial Sequence
  Detection oligonucleotide for F12
atattttcggtgagtgt

SEQ ID NO: 1772 - DNA, 18 bp, Artificial Sequence
  Detection oligonucleotide for F12
aatatttttggtgagtgt

SEQ ID NO: 1773 - DNA, 17 bp, Artificial Sequence
  Detection oligonucleotide for F12
ggggggtcgttattata

SEQ ID NO: 1774 - DNA, 17 bp, Artificial Sequence
  Detection oligonucleotide for F12
ggggggttgttattata

SEQ ID NO: 1775 - DNA, 16 bp, Artificial Sequence
  Detection oligonucleotide for F12
gttagttcggaaggtt

SEQ ID NO: 1776 - DNA, 16 bp, Artificial Sequence
  Detection oligonucleotide for F12
ggttagtttggaaggt

SEQ ID NO: 1777 - DNA, 16 bp, Artificial Sequence
  Detection oligonucleotide for REN
ttattgcgggatagag

SEQ ID NO: 1778 - DNA, 17 bp, Artificial Sequence
  Detection oligonucleotide for REN
ttattgtgggatagagt

SEQ ID NO: 1779 - DNA, 17 bp, Artificial Sequence
  Detection oligonucleotide for REN
tttttagcgaggtattt

SEQ ID NO: 1780 - DNA, 18 bp, Artificial Sequence
  Detection oligonucleotide for REN
agtttttagtgaggtatt

SEQ ID NO: 1781 - DNA, 16 bp, Artificial Sequence
  Detection oligonucleotide for REN
gtttgtcgggagatta

SEQ ID NO: 1782 - DNA, 17 bp, Artificial Sequence
  Detection oligonucleotide for REN
tgtttgttgggagatta

SEQ ID NO: 1783 - DNA, 19 bp, Artificial Sequence
  Detection oligonucleotide for REN
taattatcgtttaaaggtg

SEQ ID NO: 1784 - DNA, 20 bp, Artificial Sequence
  Detection oligonucleotide for REN
ttaattattgtttaaaggtg

SEQ ID NO: 1785 - DNA, 16 bp, Artificial Sequence
  Detection oligonucleotide for EBAG9
gtttgacgtcgagatt

SEQ ID NO: 1786 - DNA, 16 bp, Artificial Sequence
  Detection oligonucleotide for EBAG9
tgatgttgagattggg

SEQ ID NO: 1787 - DNA, 17 bp, Artificial Sequence
  Detection oligonucleotide for EBAG9
ttatcgggaaattcgtt

SEQ ID NO: 1788 - DNA, 19 bp, Artificial Sequence
  Detection oligonucleotide for EBAG9
ttttattgggaaatttgtt

SEQ ID NO: 1789 - DNA, 20 bp, Artificial Sequence
  Detection oligonucleotide for EBAG9
atttttagtttcgtttattt

SEQ ID NO: 1790 - DNA, 21 bp, Artificial Sequence
  Detection oligonucleotide for EBAG9
tttagttttgtttatttaaag

SEQ ID NO: 1791 - DNA, 16 bp, Artificial Sequence
  Detection oligonucleotide for MSMB
attggtatcgttgagg

SEQ ID NO: 1792 - DNA, 17 bp, Artificial Sequence
  Detection oligonucleotide for MSMB
attggtattgttgaggt

SEQ ID NO: 1793 - DNA, 19 bp, Artificial Sequence
  Detection oligonucleotide for MSMB
tgtataaaatcgaataagg

SEQ ID NO: 1794 - DNA, 20 bp, Artificial Sequence
  Detection oligonucleotide for MSMB
tgtataaaattgaataagga

SEQ ID NO: 1795 - DNA, 16 bp, Artificial Sequence
  Detection oligonucleotide for X15323 angiotensinogen gene 5'region and exon 1
tagtttcgggagatgt

SEQ ID NO: 1796 - DNA, 17 bp, Artificial Sequence
  Detection oligonucleotide for X15323 angiotensinogen gene 5'region and exon 1
ttagttttgggagatgt

SEQ ID NO: 1797 - DNA, 16 bp, Artificial Sequence
  Detection oligonucleotide for X15323 angiotensinogen gene 5'region and exon 1
taggagtcggggttaa

SEQ ID NO: 1798 - DNA, 16 bp, Artificial Sequence
  Detection oligonucleotide for X15323 angiotensinogen gene 5'region and exon 1
taggagttggggttaa

SEQ ID NO: 1799 - DNA, 16 bp, Artificial Sequence
  Detection oligonucleotide for X15323 angiotensinogen gene 5'region and exon 1
agtgagtcggtgtagg

SEQ ID NO: 1800 - DNA, 16 bp, Artificial Sequence
  Detection oligonucleotide for X15323 angiotensinogen gene 5'region and exon 1
gagtgagttggtgtag

SEQ ID NO: 1801 - DNA, 17 bp, Artificial Sequence
  Detection oligonucleotide for X15323 angiotensinogen gene 5'region and exon 1
gaagcgatatttacgtt

SEQ ID NO: 1802 - DNA, 19 bp, Artificial Sequence
  Detection oligonucleotide for X15323 angiotensinogen gene 5'region and exon 1
agaagtgatatttatgttg

SEQ ID NO: 1803 - DNA, 18 bp, Artificial Sequence
  Detection oligonucleotide for ZNF147
taggtaacgtatagagat

SEQ ID NO: 1804 - DNA, 19 bp, Artificial Sequence
  Detection oligonucleotide for ZNF147
tttaggtaatgtatagaga

SEQ ID NO: 1805 - DNA, 17 bp, Artificial Sequence
  Detection oligonucleotide for ZNF147
aggagtgtcgtatttta

SEQ ID NO: 1806 - DNA, 18 bp, Artificial Sequence
  Detection oligonucleotide for ZNF147
aggagtgttgtattttag

SEQ ID NO: 1807 - DNA, 16 bp, Artificial Sequence
  Detection oligonucleotide for ZNF147
aggttagcgattttga

SEQ ID NO: 1808 - DNA, 17 bp, Artificial Sequence
  Detection oligonucleotide for ZNF147
aggttagtgattttgag

SEQ ID NO: 1809 - DNA, 20 bp, Artificial Sequence
  Detection oligonucleotide for EBBP
tttaggtcgtttttatttat

SEQ ID NO: 1810 - DNA, 21 bp, Artificial Sequence
  Detection oligonucleotide for EBBP
tttaggttgtttttatttata

SEQ ID NO: 1811 - DNA, 16 bp, Artificial Sequence
  Detection oligonucleotide for EBBP
atggtatcgagtcgtt

SEQ ID NO: 1812 - DNA, 18 bp, Artificial Sequence
  Detection oligonucleotide for EBBP
tggtattgagttgtttat

SEQ ID NO: 1813 - DNA, 17 bp, Artificial Sequence
  Detection oligonucleotide for EBBP
ggaatgtttcgttaagt

SEQ ID NO: 1814 - DNA, 17 bp, Artificial Sequence
  Detection oligonucleotide for EBBP
atgttttgttaagtggg

SEQ ID NO: 1815 - DNA, 16 bp, Artificial Sequence
  Detection oligonucleotide for EBBP
ttacgagtgtgacgga

SEQ ID NO: 1816 - DNA, 17 bp, Artificial Sequence
  Detection oligonucleotide for EBBP
ttatgagtgtgatggat

SEQ ID NO: 1817 - DNA, 18 bp, Artificial Sequence
  Detection oligonucleotide for CALR
tgtttttacgttgtagaa

SEQ ID NO: 1818 - DNA, 19 bp, Artificial Sequence
  Detection oligonucleotide for CALR
gtttttatgttgtagaaag

SEQ ID NO: 1819 - DNA, 16 bp, Artificial Sequence
  Detection oligonucleotide for CALR
agaggtacgtgattgg

SEQ ID NO: 1820 - DNA, 17 bp, Artificial Sequence
  Detection oligonucleotide for CALR
tagaggtatgtgattgg

SEQ ID NO: 1821 - DNA, 19 bp, Artificial Sequence
  Detection oligonucleotide for CALR
ttttttaatcggtaaatga

SEQ ID NO: 1822 - DNA, 20 bp, Artificial Sequence
  Detection oligonucleotide for CALR
ttttttaattggtaaatgaa

SEQ ID NO: 1823 - DNA, 18 bp, Artificial Sequence
  Detection oligonucleotide for CALR
agattgtagtcgtttttt

SEQ ID NO: 1824 - DNA, 19 bp, Artificial Sequence
  Detection oligonucleotide for CALR
agattgtagttgttttttt

SEQ ID NO: 1825 - DNA, 17 bp, Artificial Sequence
  Detection oligonucleotide for CALR
aggtttaacgatgtgat

SEQ ID NO: 1826 - DNA, 18 bp, Artificial Sequence
  Detection oligonucleotide for CALR
aggtttaatgatgtgatt

SEQ ID NO: 1827 - DNA, 18 bp, Artificial Sequence
  Detection oligonucleotide for BCAR1
agttttcgatttagcgtt

SEQ ID NO: 1828 - DNA, 19 bp, Artificial Sequence
  Detection oligonucleotide for BCAR1
agtttttgatttagtgttt

SEQ ID NO: 1829 - DNA, 18 bp, Artificial Sequence
  Detection oligonucleotide for BCAR1
tggcgagttttcgattta

SEQ ID NO: 1830 - DNA, 18 bp, Artificial Sequence
  Detection oligonucleotide for BCAR1
tggtgagtttttgattta

SEQ ID NO: 1831 - DNA, 17 bp, Artificial Sequence
  Detection oligonucleotide for BCAR1
tttcgattgtagacggt

SEQ ID NO: 1832 - DNA, 18 bp, Artificial Sequence
  Detection oligonucleotide for BCAR1
ttttgattgtagatggtt

SEQ ID NO: 1833 - DNA, 17 bp, Artificial Sequence
  Detection oligonucleotide for BCAR1
atttatcgcgtgtttat

SEQ ID NO: 1834 - DNA, 19 bp, Artificial Sequence
  Detection oligonucleotide for BCAR1
ggtatttattgtgtgttta

SEQ ID NO: 1835 - DNA, 17 bp, Artificial Sequence
  Detection oligonucleotide for AF174646 glandular kallikrein gene, promoter region and partial sequence
gttcgtatagcgtagat

SEQ ID NO: 1836 - DNA, 19 bp, Artificial Sequence
  Detection oligonucleotide for AF174646 glandular kallikrein gene, promoter region and partial sequence
gtttgtatagtgtagatgt

SEQ ID NO: 1837 - DNA, 16 bp, Artificial Sequence
  Detection oligonucleotide for AF174646 glandular kallikrein gene, promoter region and partial sequence
agaggcgcgttgtagg

SEQ ID NO: 1838 - DNA, 16 bp, Artificial Sequence
  Detection oligonucleotide for AF174646 glandular kallikrein gene, promoter region and partial sequence
agaggtgtgttgtagg

SEQ ID NO: 1839 - DNA, 16 bp, Artificial Sequence
  Detection oligonucleotide for AF174646 glandular kallikrein gene, promoter region and partial sequence
ttgggacgtgacggga

SEQ ID NO: 1840 - DNA, 16 bp, Artificial Sequence
  Detection oligonucleotide for AF174646 glandular kallikrein gene, promoter region and partial sequence
ttgggatgtgatggga

SEQ ID NO: 1841 - DNA, 16 bp, Artificial Sequence
  Detection oligonucleotide for AF174646 glandular kallikrein gene, promoter region and partial sequence
taggggacgtacgttt

SEQ ID NO: 1842 - DNA, 18 bp, Artificial Sequence
  Detection oligonucleotide for AF174646 glandular kallikrein gene, promoter region and partial sequence
tattaggggatgtatgtt

SEQ ID NO: 1843 - DNA, 16 bp, Artificial Sequence
  Detection oligonucleotide for KLK3
aatcggggatcgtatt

SEQ ID NO: 1844 - DNA, 17 bp, Artificial Sequence
  Detection oligonucleotide for KLK3
agaattggggattgtat

SEQ ID NO: 1845 - DNA, 17 bp, Artificial Sequence
  Detection oligonucleotide for KLK3
atttgtattcggagagt

SEQ ID NO: 1846 - DNA, 17 bp, Artificial Sequence
  Detection oligonucleotide for KLK3
tgtatttggagagttgt

SEQ ID NO: 1847 - DNA, 16 bp, Artificial Sequence
  Detection oligonucleotide for AKR1B1
gtttcgcgtggtagaa

SEQ ID NO: 1848 - DNA, 17 bp, Artificial Sequence
  Detection oligonucleotide for AKR1B1
gttttgtgtggtagaaa

SEQ ID NO: 1849 - DNA, 16 bp, Artificial Sequence
  Detection oligonucleotide for AKR1B1
gttgcgcgaaggagtt

SEQ ID NO: 1850 - DNA, 16 bp, Artificial Sequence
  Detection oligonucleotide for AKR1B1
gttgtgtgaaggagtt

SEQ ID NO: 1851 - DNA, 17 bp, Artificial Sequence
  Detection oligonucleotide for AKR1B1
agttcgtgaggtcggta

SEQ ID NO: 1852 - DNA, 17 bp, Artificial Sequence
  Detection oligonucleotide for AKR1B1
agtttgtgaggttggta

SEQ ID NO: 1853 - DNA, 18 bp, Artificial Sequence
  Detection oligonucleotide for AKR1B1
attttcgtttagtacggt

SEQ ID NO: 1854 - DNA, 19 bp, Artificial Sequence
  Detection oligonucleotide for AKR1B1
gatttttgtttagtatggt

SEQ ID NO: 1855 - DNA, 20 bp, Artificial Sequence
  Detection oligonucleotide for TGM4
taataaaatttcggaatttt

SEQ ID NO: 1856 - DNA, 21 bp, Artificial Sequence
  Detection oligonucleotide for TGM4
taataaaattttggaattttt

SEQ ID NO: 1857 - DNA, 16 bp, Artificial Sequence
  Detection oligonucleotide for TGM4
ggaaggcgatgttgat

SEQ ID NO: 1858 - DNA, 16 bp, Artificial Sequence
  Detection oligonucleotide for TGM4
ggaaggtgatgttgat

SEQ ID NO: 1859 - DNA, 18 bp, Artificial Sequence
  Detection oligonucleotide for TGM4
atatagtcggtttttagg

SEQ ID NO: 1860 - DNA, 18 bp, Artificial Sequence
  Detection oligonucleotide for TGM4
tatagttggtttttaggg

SEQ ID NO: 1861 - DNA, 16 bp, Artificial Sequence
  Detection oligonucleotide for TGM4
aggtattcggtagagg

SEQ ID NO: 1862 - DNA, 17 bp, Artificial Sequence
  Detection oligonucleotide for TGM4
aggtatttggtagaggt

SEQ ID NO: 1863 - DNA, 16 bp, Artificial Sequence
  Detection oligonucleotide for AR
aagaggcgaaaagtag

SEQ ID NO: 1864 - DNA, 17 bp, Artificial Sequence
  Detection oligonucleotide for AR
aagaggtgaaaagtagt

SEQ ID NO: 1865 - DNA, 17 bp, Artificial Sequence
  Detection oligonucleotide for AR
agtaagcggttgtatat

SEQ ID NO: 1866 - DNA, 18 bp, Artificial Sequence
  Detection oligonucleotide for AR
aaaagtaagtggttgtat

SEQ ID NO: 1867 - DNA, 17 bp, Artificial Sequence
  Detection oligonucleotide for AR
aaattgagcgtttatgt

SEQ ID NO: 1868 - DNA, 18 bp, Artificial Sequence
  Detection oligonucleotide for AR
attgagtgtttatgtgta

SEQ ID NO: 1869 - DNA, 16 bp, Artificial Sequence
  Detection oligonucleotide for HSPA1A
aggcgtcgggagatta

SEQ ID NO: 1870 - DNA, 16 bp, Artificial Sequence
  Detection oligonucleotide for HSPA1A
aggtgttgggagatta

SEQ ID NO: 1871 - DNA, 18 bp, Artificial Sequence
  Detection oligonucleotide for HSPA1A
ttgcgtaatttggacgtt

SEQ ID NO: 1872 - DNA, 18 bp, Artificial Sequence
  Detection oligonucleotide for HSPA1A
ttgtgtaatttggatgtt

SEQ ID NO: 1873 - DNA, 18 bp, Artificial Sequence
  Detection oligonucleotide for HSPA1A
gttcggttacgttataat

SEQ ID NO: 1874 - DNA, 20 bp, Artificial Sequence
  Detection oligonucleotide for HSPA1A
gtttggttatgttataatgg

SEQ ID NO: 1875 - DNA, 17 bp, Artificial Sequence
  Detection oligonucleotide for HSPA1A
ttgatatcgttcggtta

SEQ ID NO: 1876 - DNA, 19 bp, Artificial Sequence
  Detection oligonucleotide for HSPA1A
tgttgatattgtttggtta

SEQ ID NO: 1877 - DNA, 18 bp, Artificial Sequence
  Detection oligonucleotide for HSPA1A
atggcgatgttgatcgtt

SEQ ID NO: 1878 - DNA, 18 bp, Artificial Sequence
  Detection oligonucleotide for HSPA1A
atggtgatgttgattgtt

SEQ ID NO: 1879 - DNA, 18 bp, Artificial Sequence
  Detection oligonucleotide for FKBP4
tttatatttcgtcgtagg

SEQ ID NO: 1880 - DNA, 20 bp, Artificial Sequence
  Detection oligonucleotide for FKBP4
tttttatattttgttgtagg

SEQ ID NO: 1881 - DNA, 16 bp, Artificial Sequence
  Detection oligonucleotide for FKBP4
atgtcgggagatcgat

SEQ ID NO: 1882 - DNA, 17 bp, Artificial Sequence
  Detection oligonucleotide for FKBP4
gatgttgggagattgat

SEQ ID NO: 1883 - DNA, 16 bp, Artificial Sequence
  Detection oligonucleotide for FKBP4
aggtcgtcggggagat

SEQ ID NO: 1884 - DNA, 16 bp, Artificial Sequence
  Detection oligonucleotide for FKBP4
aggttgttggggagat

SEQ ID NO: 1885 - DNA, 16 bp, Artificial Sequence
  Detection oligonucleotide for FKBP4
agatttcgagttcgag

SEQ ID NO: 1886 - DNA, 17 bp, Artificial Sequence
  Detection oligonucleotide for FKBP4
attttgagtttgagggt

SEQ ID NO: 1887 - DNA, 17 bp, Artificial Sequence
  Detection oligonucleotide for ESR2
atttcgaggattacgtt

SEQ ID NO: 1888 - DNA, 19 bp, Artificial Sequence
  Detection oligonucleotide for ESR2
attttgaggattatgtttt

SEQ ID NO: 1889 - DNA, 17 bp, Artificial Sequence
  Detection oligonucleotide for ESR2
agatggcgtttttcgta

SEQ ID NO: 1890 - DNA, 18 bp, Artificial Sequence
  Detection oligonucleotide for ESR2
tagatggtgttttttgta

SEQ ID NO: 1891 - DNA, 18 bp, Artificial Sequence
  Detection oligonucleotide for ESR2
attttcgaatcgattttt

SEQ ID NO: 1892 - DNA, 19 bp, Artificial Sequence
  Detection oligonucleotide for ESR2
ggagtatttttgaattgat

SEQ ID NO: 1893 - DNA, 16 bp, Artificial Sequence
  Detection oligonucleotide for ESR2
agttcgacggttttag

SEQ ID NO: 1894 - DNA, 16 bp, Artificial Sequence
  Detection oligonucleotide for ESR2
agggagtttgatggtt

SEQ ID NO: 1895 - DNA, 16 bp, Artificial Sequence
  Detection oligonucleotide for ESR2
agtttacgtgatcgag

SEQ ID NO: 1896 - DNA, 18 bp, Artificial Sequence
  Detection oligonucleotide for ESR2
agtttatgtgattgagtt

SEQ ID NO: 1897 - DNA, 17 bp, Artificial Sequence
  Detection oligonucleotide for IGF1
agattatgtcgagttgt

SEQ ID NO: 1898 - DNA, 18 bp, Artificial Sequence
  Detection oligonucleotide for IGF1
aagattatgttgagttgt

SEQ ID NO: 1899 - DNA, 17 bp, Artificial Sequence
  Detection oligonucleotide for IGF1
tagtattcgggtgattt

SEQ ID NO: 1900 - DNA, 18 bp, Artificial Sequence
  Detection oligonucleotide for IGF1
agatagtatttgggtgat

SEQ ID NO: 1901 - DNA, 17 bp, Artificial Sequence
  Detection oligonucleotide for IGF1
agaaaggacgataagat

SEQ ID NO: 1902 - DNA, 18 bp, Artificial Sequence
  Detection oligonucleotide for IGF1
agaaaggatgataagatt

SEQ ID NO: 1903 - DNA, 16 bp, Artificial Sequence
  Detection oligonucleotide for CTSL
gggtcgggtggacgaa

SEQ ID NO: 1904 - DNA, 16 bp, Artificial Sequence
  Detection oligonucleotide for CTSL
gggttgggtggatgaa

SEQ ID NO: 1905 - DNA, 16 bp, Artificial Sequence
  Detection oligonucleotide for CTSL
taaacgtggggtcggg

SEQ ID NO: 1906 - DNA, 16 bp, Artificial Sequence
  Detection oligonucleotide for CTSL
taaatgtggggttggg

SEQ ID NO: 1907 - DNA, 16 bp, Artificial Sequence
  Detection oligonucleotide for CTSL
gagcgttcgagttaat

SEQ ID NO: 1908 - DNA, 17 bp, Artificial Sequence
  Detection oligonucleotide for CTSL
ttggagtgtttgagtta

SEQ ID NO: 1909 - DNA, 16 bp, Artificial Sequence
  Detection oligonucleotide for TGFB3
aggacgaagaagcgga

SEQ ID NO: 1910 - DNA, 16 bp, Artificial Sequence
  Detection oligonucleotide for TGFB3
aggatgaagaagtgga

SEQ ID NO: 1911 - DNA, 16 bp, Artificial Sequence
  Detection oligonucleotide for TGFB3
taggaagcgttggtaa

SEQ ID NO: 1912 - DNA, 17 bp, Artificial Sequence
  Detection oligonucleotide for TGFB3
tttaggaagtgttggta

SEQ ID NO: 1913 - DNA, 17 bp, Artificial Sequence
  Detection oligonucleotide for TGFB3
tagtagacgtgtagaag

SEQ ID NO: 1914 - DNA, 17 bp, Artificial Sequence
  Detection oligonucleotide for TGFB3
agtagatgtgtagaagg

SEQ ID NO: 1915 - DNA, 16 bp, Artificial Sequence
  Detection oligonucleotide for TGFB3
aggttgatcgtggtaa

SEQ ID NO: 1916 - DNA, 17 bp, Artificial Sequence
  Detection oligonucleotide for TGFB3
aggttgattgtggtaaa

SEQ ID NO: 1917 - DNA, 18 bp, Artificial Sequence
  Detection oligonucleotide for MAPKAPK5
agtagtcgtttttcggga

SEQ ID NO: 1918 - DNA, 18 bp, Artificial Sequence
  Detection oligonucleotide for MAPKAPK5
agtagttgttttttggga

SEQ ID NO: 1919 - DNA, 16 bp, Artificial Sequence
  Detection oligonucleotide for MAPKAPK5
aattcggtagtcgatg

SEQ ID NO: 1920 - DNA, 17 bp, Artificial Sequence
  Detection oligonucleotide for MAPKAPK5
atttggtagttgatgga

SEQ ID NO: 1921 - DNA, 17 bp, Artificial Sequence
  Detection oligonucleotide for MAPKAPK5
attcgggggaggtcgaa

SEQ ID NO: 1922 - DNA, 17 bp, Artificial Sequence
  Detection oligonucleotide for MAPKAPK5
atttgggggaggttgaa

SEQ ID NO: 1923 - DNA, 16 bp, Artificial Sequence
  Detection oligonucleotide for MAPKAPK5
atttacggaattcggg

SEQ ID NO: 1924 - DNA, 16 bp, Artificial Sequence
  Detection oligonucleotide for MAPKAPK5
ttatggaatttggggg

SEQ ID NO: 1925 - DNA, 17 bp, Artificial Sequence
  Detection oligonucleotide for PCAF
gagcggtaggtgtcgaa

SEQ ID NO: 1926 - DNA, 17 bp, Artificial Sequence
  Detection oligonucleotide for PCAF
gagtggtaggtgttgaa

SEQ ID NO: 1927 - DNA, 16 bp, Artificial Sequence
  Detection oligonucleotide for PCAF
taagatttcgcgggta

SEQ ID NO: 1928 - DNA, 18 bp, Artificial Sequence
  Detection oligonucleotide for PCAF
tgtaagattttgtgggta

SEQ ID NO: 1929 - DNA, 16 bp, Artificial Sequence
  Detection oligonucleotide for PCAF
agttcgtagtttcgag

SEQ ID NO: 1930 - DNA, 17 bp, Artificial Sequence
  Detection oligonucleotide for PCAF
gtttgtagttttgagga

SEQ ID NO: 1931 - DNA, 16 bp, Artificial Sequence
  Detection oligonucleotide for PCAF
tagggcgcggagtaga

SEQ ID NO: 1932 - DNA, 16 bp, Artificial Sequence
  Detection oligonucleotide for PCAF
tagggtgtggagtaga

SEQ ID NO: 1933 - DNA, 18 bp, Artificial Sequence
  Detection oligonucleotide for NCOA3
gatgatatttcgggatta

SEQ ID NO: 1934 - DNA, 19 bp, Artificial Sequence
  Detection oligonucleotide for NCOA3
gatgatattttgggattaa

SEQ ID NO: 1935 - DNA, 20 bp, Artificial Sequence
  Detection oligonucleotide for NCOA3
atagtttcgtggttttcgat

SEQ ID NO: 1936 - DNA, 20 bp, Artificial Sequence
  Detection oligonucleotide for NCOA3
atagttttgtggtttttgat

SEQ ID NO: 1937 - DNA, 19 bp, Artificial Sequence
  Detection oligonucleotide for NCOA3
tttagttcgtttatttgaa

SEQ ID NO: 1938 - DNA, 20 bp, Artificial Sequence
  Detection oligonucleotide for NCOA3
tttagtttgtttatttgaaa

SEQ ID NO: 1939 - DNA, 17 bp, Artificial Sequence
  Detection oligonucleotide for NCOA3
aggattcgtgtttggta

SEQ ID NO: 1940 - DNA, 17 bp, Artificial Sequence
  Detection oligonucleotide for NCOA3
aggatttgtgtttggta

SEQ ID NO: 1941 - DNA, 17 bp, Artificial Sequence
  Detection oligonucleotide for TMEFF2
tatcgtagttcgttcgg

SEQ ID NO: 1942 - DNA, 17 bp, Artificial Sequence
  Detection oligonucleotide for TMEFF2
attgtagtttgtttggt

SEQ ID NO: 1943 - DNA, 16 bp, Artificial Sequence
  Detection oligonucleotide for TMEFF2
aaacgtttatcggttg

SEQ ID NO: 1944 - DNA, 17 bp, Artificial Sequence
  Detection oligonucleotide for TMEFF2
aatgtttattggttgga

SEQ ID NO: 1945 - DNA, 20 bp, Artificial Sequence
  Detection oligonucleotide for TMEFF2
ttcgtagaagaatacgcgta

SEQ ID NO: 1946 - DNA, 20 bp, Artificial Sequence
  Detection oligonucleotide for TMEFF2
tttgtagaagaatatgtgta

SEQ ID NO: 1947 - DNA, 17 bp, Artificial Sequence
  Detection oligonucleotide for ESR1
tgcggttgtatacgtag

SEQ ID NO: 1948 - DNA, 17 bp, Artificial Sequence
  Detection oligonucleotide for ESR1
tgtgtggttgtatatgt

SEQ ID NO: 1949 - DNA, 20 bp, Artificial Sequence
  Detection oligonucleotide for ESR1
ttcgtgttagatttcgatat

SEQ ID NO: 1950 - DNA, 20 bp, Artificial Sequence
  Detection oligonucleotide for ESR1
tttgtgttagattttgatat

SEQ ID NO: 1951 - DNA, 16 bp, Artificial Sequence
  Detection oligonucleotide for ESR1
aacgcgaaagacggat

SEQ ID NO: 1952 - DNA, 18 bp, Artificial Sequence
  Detection oligonucleotide for ESR1
ataaatgtgaaagatgga

SEQ ID NO: 1953 - DNA, 16 bp, Artificial Sequence
  Detection oligonucleotide for ESR1
gggcgtacgaggattt

SEQ ID NO: 1954 - DNA, 16 bp, Artificial Sequence
  Detection oligonucleotide for ESR1
gggtgtatgaggattt

SEQ ID NO: 1955 - DNA, 16 bp, Artificial Sequence
  Detection oligonucleotide for PITX2
atgttagcgggtcgaa

SEQ ID NO: 1956 - DNA, 16 bp, Artificial Sequence
  Detection oligonucleotide for PITX2
tagtgggttgaagagt

SEQ ID NO: 1957 - DNA, 17 bp, Artificial Sequence
  Detection oligonucleotide for PCAF
gagcggtaggtgtcgaa

SEQ ID NO: 1958 - DNA, 17 bp, Artificial Sequence
  Detection oligonucleotide for PCAF
gagtggtaggtgttgaa

SEQ ID NO: 1959 - DNA, 16 bp, Artificial Sequence
  Detection oligonucleotide for PCAF
taagatttcgcgggta

SEQ ID NO: 1960 - DNA, 18 bp, Artificial Sequence
  Detection oligonucleotide for PCAF
tgtaagattttgtgggta

SEQ ID NO: 1961 - DNA, 16 bp, Artificial Sequence
  Detection oligonucleotide for PCAF
agttcgtagtttcgag

SEQ ID NO: 1962 - DNA, 17 bp, Artificial Sequence
  Detection oligonucleotide for PCAF
gtttgtagttttgagga

SEQ ID NO: 1963 - DNA, 16 bp, Artificial Sequence
  Detection oligonucleotide for PCAF
tagggcgcggagtaga

SEQ ID NO: 1964 - DNA, 16 bp, Artificial Sequence
  Detection oligonucleotide for PCAF
tagggtgtggagtaga

SEQ ID NO: 1965 - DNA, 16 bp, Artificial Sequence
  Detection oligonucleotide for PCAF
agcgtcggtacgtata

SEQ ID NO: 1966 - DNA, 16 bp, Artificial Sequence
  Detection oligonucleotide for PCAF
ggtagtgttggtatgt

SEQ ID NO: 1967 - DNA, 17 bp, Artificial Sequence
  Detection oligonucleotide for S100A2
tgtatacgagtattgga

SEQ ID NO: 1968 - DNA, 19 bp, Artificial Sequence
  Detection oligonucleotide for S100A2
tatgtatatgagtattgga

SEQ ID NO: 1969 - DNA, 20 bp, Artificial Sequence
  Detection oligonucleotide for TFF1
agaatttatcgtataaaaag

SEQ ID NO: 1970 - DNA, 20 bp, Artificial Sequence
  Detection oligonucleotide for TFF1
aatttattgtataaaaaggt

SEQ ID NO: 1971 - DNA, 16 bp, Artificial Sequence
  Detection oligonucleotide for TFF1
ggacgtcgatggtatt

SEQ ID NO: 1972 - DNA, 16 bp, Artificial Sequence
  Detection oligonucleotide for TFF1
agggatgttgatggta

SEQ ID NO: 1973 - DNA, 16 bp, Artificial Sequence
  Detection oligonucleotide for TFF1
aacggtgtcgtcgaaa

SEQ ID NO: 1974 - DNA, 17 bp, Artificial Sequence
  Detection oligonucleotide for TFF1
aatggtgttgttgaaat

SEQ ID NO: 1975 - DNA, 16 bp, Artificial Sequence
  Detection oligonucleotide for PSA
atagtaaacgcgagga

SEQ ID NO: 1976 - DNA, 16 bp, Artificial Sequence
  Detection oligonucleotide for PSA
agtaaatgtgaggagg

SEQ ID NO: 1977 - DNA, 20 bp, Artificial Sequence
  Detection oligonucleotide for CGA
atatttattttcggaaattt

SEQ ID NO: 1978 - DNA, 21 bp, Artificial Sequence
  Detection oligonucleotide for CGA
ttatttttggaaatttatagt

SEQ ID NO: 1979 - DNA, 19 bp, Artificial Sequence
  Detection oligonucleotide for CGA
tgattttgtcgttattatt

SEQ ID NO: 1980 - DNA, 20 bp, Artificial Sequence
  Detection oligonucleotide for CGA
ttgattttgttgttattatt

SEQ ID NO: 1981 - DNA, 17 bp, Artificial Sequence
  Detection oligonucleotide for RASSF1
agtaaatcggattagga

SEQ ID NO: 1982 - DNA, 18 bp, Artificial Sequence
  Detection oligonucleotide for RASSF1
agtaaattggattaggag

SEQ ID NO: 1983 - DNA, 17 bp, Artificial Sequence
  Detection oligonucleotide for RASSF1
tacgggtattttcgcgt

SEQ ID NO: 1984 - DNA, 18 bp, Artificial Sequence
  Detection oligonucleotide for RASSF1
atatgggtatttttgtgt

SEQ ID NO: 1985 - DNA, 16 bp, Artificial Sequence
  Detection oligonucleotide for RASSF1
tgcgagagcgcgttta

SEQ ID NO: 1986 - DNA, 17 bp, Artificial Sequence
  Detection oligonucleotide for RASSF1
ttgtgagagtgtgttta

SEQ ID NO: 1987 - DNA, 16 bp, Artificial Sequence
  Detection oligonucleotide for TP53
tattaggtcggcgaga

SEQ ID NO: 1988 - DNA, 16 bp, Artificial Sequence
  Detection oligonucleotide for TP53
aggttggtgagaattt

SEQ ID NO: 1989 - DNA, 16 bp, Artificial Sequence
  Detection oligonucleotide for TP53
ttcggtaggcggatta

SEQ ID NO: 1990 - DNA, 16 bp, Artificial Sequence
  Detection oligonucleotide for TP53
tttttggtaggtggat

SEQ ID NO: 1991 - DNA, 16 bp, Artificial Sequence
  Detection oligonucleotide for TP53
atattttgcgttcggg

SEQ ID NO: 1992 - DNA, 17 bp, Artificial Sequence
  Detection oligonucleotide for TP53
atattttgtgtttgggt

SEQ ID NO: 1993 - DNA, 16 bp, Artificial Sequence
  Detection oligonucleotide for TP53
tacgacggtgatacgt

SEQ ID NO: 1994 - DNA, 18 bp, Artificial Sequence
  Detection oligonucleotide for TP53
tttatgatggtgatatgt

SEQ ID NO: 1995 - DNA, 16 bp, Artificial Sequence
  Detection oligonucleotide for ERBB2
tgtgagaacggttgta

SEQ ID NO: 1996 - DNA, 16 bp, Artificial Sequence
  Detection oligonucleotide for ERBB2
tgagaatggttgtagg

SEQ ID NO: 1997 - DNA, 16 bp, Artificial Sequence
  Detection oligonucleotide for ERBB2
ttaggcgtttcggcgt

SEQ ID NO: 1998 - DNA, 17 bp, Artificial Sequence
  Detection oligonucleotide for ERBB2
tttaggtgttttggtgt

SEQ ID NO: 1999 - DNA, 16 bp, Artificial Sequence
  Detection oligonucleotide for ERBB2
taggtttgcgcgaaga

SEQ ID NO: 2000 - DNA, 16 bp, Artificial Sequence
  Detection oligonucleotide for ERBB2
tttgtgtgaagagagg

SEQ ID NO: 2001 - DNA, 17 bp, Artificial Sequence
  Detection oligonucleotide for ERBB2
taattatcggagaagga

SEQ ID NO: 2002 - DNA, 18 bp, Artificial Sequence
  Detection oligonucleotide for ERBB2
taattattggagaaggag

SEQ ID NO: 2003 - DNA, 18 bp, Artificial Sequence
  Detection oligonucleotide for STMN1
gttatcggttcgggaatt

SEQ ID NO: 2004 - DNA, 18 bp, Artificial Sequence
  Detection oligonucleotide for STMN1
gttattggtttgggaatt

SEQ ID NO: 2005 - DNA, 20 bp, Artificial Sequence
  Detection oligonucleotide for STMN1
gtaagaacgtatatagtgag

SEQ ID NO: 2006 - DNA, 20 bp, Artificial Sequence
  Detection oligonucleotide for STMN1
gtaagaatgtatatagtgag

SEQ ID NO: 2007 - DNA, 20 bp, Artificial Sequence
  Detection oligonucleotide for STMN1
agaaattacgatgatgttat

SEQ ID NO: 2008 - DNA, 20 bp, Artificial Sequence
  Detection oligonucleotide for STMN1
agaaattatgatgatgttat

SEQ ID NO: 2009 - DNA, 18 bp, Artificial Sequence
  Detection oligonucleotide for STMN1
atgggtgatacgtcggtg

SEQ ID NO: 2010 - DNA, 18 bp, Artificial Sequence
  Detection oligonucleotide for STMN1
atgggtgatatgttggtg

SEQ ID NO: 2011 - DNA, 17 bp, Artificial Sequence
  Detection oligonucleotide for PSA
tttcgattcggtttaga

SEQ ID NO: 2012 - DNA, 18 bp, Artificial Sequence
  Detection oligonucleotide for PSA
aattgttttgatttggtt

SEQ ID NO: 2013 - DNA, 16 bp, Artificial Sequence
  Detection oligonucleotide for PSA
taatggggcgtcgatt

SEQ ID NO: 2014 - DNA, 17 bp, Artificial Sequence
  Detection oligonucleotide for PSA
ttaatggggtgttgatt

SEQ ID NO: 2015 - DNA, 16 bp, Artificial Sequence
  Detection oligonucleotide for PSA
tatcgtagcggttagg

SEQ ID NO: 2016 - DNA, 18 bp, Artificial Sequence
  Detection oligonucleotide for PSA
tattgtagtggttaggaa

SEQ ID NO: 2017 - DNA, 16 bp, Artificial Sequence
  Detection oligonucleotide for PSA
aggaacgttagtcgtt

SEQ ID NO: 2018 - DNA, 18 bp, Artificial Sequence
  Detection oligonucleotide for PSA
taggaatgttagttgttt

SEQ ID NO: 2019 - DNA, 17 bp, Artificial Sequence
  Detection oligonucleotide for PSA
ggtcgtcgtattatgga

SEQ ID NO: 2020 - DNA, 18 bp, Artificial Sequence
  Detection oligonucleotide for PSA
tggttgttgtattatgga

SEQ ID NO: 2021 - DNA, 18 bp, Artificial Sequence
  Detection oligonucleotide for CGA
taaattgacgttatggta

SEQ ID NO: 2022 - DNA, 19 bp, Artificial Sequence
  Detection oligonucleotide for CGA
aaattgatgttatggtaaa

SEQ ID NO: 2023 - DNA, 18 bp, Artificial Sequence
  Detection oligonucleotide for CGA
aattgacgttatggtaat

SEQ ID NO: 2024 - DNA, 19 bp, Artificial Sequence
  Detection oligonucleotide for CGA
taaaaattgatgttatggt

SEQ ID NO: 2025 - DNA, 16 bp, Artificial Sequence
  Detection oligonucleotide for PITX2
agtcgggagagcgaaa

SEQ ID NO: 2026 - DNA, 16 bp, Artificial Sequence
  Detection oligonucleotide for PITX2
agttgggagagtgaaa

SEQ ID NO: 2027 - DNA, 17 bp, Artificial Sequence
  Detection oligonucleotide for PITX2
aagagtcgggagtcgga

SEQ ID NO: 2028 - DNA, 17 bp, Artificial Sequence
  Detection oligonucleotide for PITX2
aagagttgggagttgga

SEQ ID NO: 2029 - DNA, 16 bp, Artificial Sequence
  Detection oligonucleotide for PITX2
ggtcgaagagtcggga

SEQ ID NO: 2030 - DNA, 16 bp, Artificial Sequence
  Detection oligonucleotide for PITX2
ggttgaagagttggga

SEQ ID NO: 2031 - DNA, 18 bp, Artificial Sequence
  Detection oligonucleotide for FGFR1
gtatttcgttggttaagt

SEQ ID NO: 2032 - DNA, 18 bp, Artificial Sequence
  Detection oligonucleotide for FGFR1
gtgtattttgttggttaa

SEQ ID NO: 2033 - DNA, 17 bp, Artificial Sequence
  Detection oligonucleotide for FGFR1
atgtgaacgaagttaag

SEQ ID NO: 2034 - DNA, 18 bp, Artificial Sequence
  Detection oligonucleotide for FGFR1
atgtgaatgaagttaaga

SEQ ID NO: 2035 - DNA, 20 bp, Artificial Sequence
  Detection oligonucleotide for PTGS2
tttatcgggtttacgtaatt

SEQ ID NO: 2036 - DNA, 20 bp, Artificial Sequence
  Detection oligonucleotide for PTGS2
tttattgggtttatgtaatt

SEQ ID NO: 2037 - DNA, 18 bp, Artificial Sequence
  Detection oligonucleotide for PTGS2
gtacgaaaaggcggaaag

SEQ ID NO: 2038 - DNA, 18 bp, Artificial Sequence
  Detection oligonucleotide for PTGS2
gtatgaaaaggtggaaag

SEQ ID NO: 2039 - DNA, 16 bp, Artificial Sequence
  Detection oligonucleotide for MSMB
atagggcgaaggttta

SEQ ID NO: 2040 - DNA, 17 bp, Artificial Sequence
  Detection oligonucleotide for MSMB
atagggtgaaggtttag

SEQ ID NO: 2041 - DNA, 16 bp, Artificial Sequence
  Detection oligonucleotide for TP53
tttttacgacggtgat

SEQ ID NO: 2042 - DNA, 18 bp, Artificial Sequence
  Detection oligonucleotide for TP53
tgttttttatgatggtga

SEQ ID NO: 2043 - DNA, 16 bp, Artificial Sequence
  Detection oligonucleotide for CYP2D6
aagtagcggtaaggat

SEQ ID NO: 2044 - DNA, 17 bp, Artificial Sequence
  Detection oligonucleotide for CYP2D6
gaagtagtggtaaggat

SEQ ID NO: 2045 - DNA, 18 bp, Artificial Sequence
  Detection oligonucleotide for S100A2
tttaattgcggttgtgtg

SEQ ID NO: 2046 - DNA, 18 bp, Artificial Sequence
  Detection oligonucleotide for S100A2
tttaattgtggttgtgtg

SEQ ID NO: 2047 - DNA, 18 bp, Artificial Sequence
  Detection oligonucleotide for S100A2
tatataggcgtatgtatg

SEQ ID NO: 2048 - DNA, 18 bp, Artificial Sequence
  Detection oligonucleotide for S100A2
tatataggtgtatgtatg

SEQ ID NO: 2049 - DNA, 20 bp, Artificial Sequence
  Detection oligonucleotide for S100A2
tatgtatacgagtattggat

SEQ ID NO: 2050 - DNA, 20 bp, Artificial Sequence
  Detection oligonucleotide for S100A2
tatgtatatgagtattggat

SEQ ID NO: 2051 - DNA, 18 bp, Artificial Sequence
  Detection oligonucleotide for S100A2
agttttagcgtgtgttta

SEQ ID NO: 2052 - DNA, 18 bp, Artificial Sequence
  Detection oligonucleotide for S100A2
agttttagtgtgtgttta

SEQ ID NO: 2053 - DNA, 18 bp, Artificial Sequence
  Detection oligonucleotide for SFN
gagtaggtcgaacgttat

SEQ ID NO: 2054 - DNA, 18 bp, Artificial Sequence
  Detection oligonucleotide for SFN
gagtaggttgaatgttat

SEQ ID NO: 2055 - DNA, 18 bp, Artificial Sequence
  Detection oligonucleotide for SFN
tttgcgaagagcgaaatt

SEQ ID NO: 2056 - DNA, 18 bp, Artificial Sequence
  Detection oligonucleotide for SFN
tttgtgaagagtgaaatt

SEQ ID NO: 2057 - DNA, 18 bp, Artificial Sequence
  Detection oligonucleotide for SFN
taacgaggagggttcgga

SEQ ID NO: 2058 - DNA, 18 bp, Artificial Sequence
  Detection oligonucleotide for SFN
taatgaggagggtttgga

SEQ ID NO: 2059 - DNA, 18 bp, Artificial Sequence
  Detection oligonucleotide for SFN
gttcgaggtgcgtgagta

SEQ ID NO: 2060 - DNA, 18 bp, Artificial Sequence
  Detection oligonucleotide for SFN
gtttgaggtgtgtgagta

SEQ ID NO: 2061 - DNA, 19 bp, Artificial Sequence
  Detection oligonucleotide for PRKCD
atttatttttcgttgtagg

SEQ ID NO: 2062 - DNA, 20 bp, Artificial Sequence
  Detection oligonucleotide for PRKCD
tatttattttttgttgtagg

SEQ ID NO: 2063 - DNA, 16 bp, Artificial Sequence
  Detection oligonucleotide for PRKCD
tttcggaaacgggaat

SEQ ID NO: 2064 - DNA, 17 bp, Artificial Sequence
  Detection oligonucleotide for PRKCD
tagttttggaaatggga

SEQ ID NO: 2065 - DNA, 16 bp, Artificial Sequence
  Detection oligonucleotide for PRKCD
ggacggagttatcggt

SEQ ID NO: 2066 - DNA, 17 bp, Artificial Sequence
  Detection oligonucleotide for PRKCD
ggatggagttattggta

SEQ ID NO: 2067 - DNA, 16 bp, Artificial Sequence
  Detection oligonucleotide for PRKCD
gtttagcggagggata

SEQ ID NO: 2068 - DNA, 16 bp, Artificial Sequence
  Detection oligonucleotide for PRKCD
tgtttagtggagggat

SEQ ID NO: 2069 - DNA, 16 bp, Artificial Sequence
  Detection oligonucleotide for SYK
gaagttatcgcgttgg

SEQ ID NO: 2070 - DNA, 17 bp, Artificial Sequence
  Detection oligonucleotide for SYK
agaagttattgtgttgg

SEQ ID NO: 2071 - DNA, 16 bp, Artificial Sequence
  Detection oligonucleotide for SYK
gatcgatgcggtttat

SEQ ID NO: 2072 - DNA, 17 bp, Artificial Sequence
  Detection oligonucleotide for SYK
gggattgatgtggttta

SEQ ID NO: 2073 - DNA, 16 bp, Artificial Sequence
  Detection oligonucleotide for SYK
gttcggcgggaggaga

SEQ ID NO: 2074 - DNA, 16 bp, Artificial Sequence
  Detection oligonucleotide for SYK
gtttggtgggaggaga

SEQ ID NO: 2075 - DNA, 17 bp, Artificial Sequence
  Detection oligonucleotide for SYK
agtcgattttcgtttag

SEQ ID NO: 2076 - DNA, 19 bp, Artificial Sequence
  Detection oligonucleotide for SYK
tagttgatttttgtttagt

SEQ ID NO: 2077 - DNA, 16 bp, Artificial Sequence
  Detection oligonucleotide for SYK
ggaagagtcgcgggtt

SEQ ID NO: 2078 - DNA, 16 bp, Artificial Sequence
  Detection oligonucleotide for SYK
ggaagagttgtgggtt

SEQ ID NO: 2079 - DNA, 16 bp, Artificial Sequence
  Detection oligonucleotide for VTN
ggtggtatcgattgat

SEQ ID NO: 2080 - DNA, 17 bp, Artificial Sequence
  Detection oligonucleotide for VTN
tggtggtattgattgat

SEQ ID NO: 2081 - DNA, 16 bp, Artificial Sequence
  Detection oligonucleotide for VTN
tagtgattcgcgggga

SEQ ID NO: 2082 - DNA, 16 bp, Artificial Sequence
  Detection oligonucleotide for VTN
tagtgatttgtgggga

SEQ ID NO: 2083 - DNA, 16 bp, Artificial Sequence
  Detection oligonucleotide for VTN
ttatgtcggaggatga

SEQ ID NO: 2084 - DNA, 17 bp, Artificial Sequence
  Detection oligonucleotide for VTN
attatgttggaggatga

SEQ ID NO: 2085 - DNA, 17 bp, Artificial Sequence
  Detection oligonucleotide for VTN
atacggtttatgacgat

SEQ ID NO: 2086 - DNA, 19 bp, Artificial Sequence
  Detection oligonucleotide for VTN
atatggtttatgatgatgg

SEQ ID NO: 2087 - DNA, 16 bp, Artificial Sequence
  Detection oligonucleotide for GRIN2D
gagagtcgggatgatt

SEQ ID NO: 2088 - DNA, 16 bp, Artificial Sequence
  Detection oligonucleotide for GRIN2D
ggagagttgggatgat

SEQ ID NO: 2089 - DNA, 17 bp, Artificial Sequence
  Detection oligonucleotide for GRIN2D
agagatttcgatttgga

SEQ ID NO: 2090 - DNA, 18 bp, Artificial Sequence
  Detection oligonucleotide for GRIN2D
aagagattttgatttgga

SEQ ID NO: 2091 - DNA, 16 bp, Artificial Sequence
  Detection oligonucleotide for GRIN2D
tagggtcgagatttgg

SEQ ID NO: 2092 - DNA, 17 bp, Artificial Sequence
  Detection oligonucleotide for GRIN2D
ttagggttgagatttgg

SEQ ID NO: 2093 - DNA, 16 bp, Artificial Sequence
  Detection oligonucleotide for GRIN2D
agtgtggcgaatattg

SEQ ID NO: 2094 - DNA, 17 bp, Artificial Sequence
  Detection oligonucleotide for GRIN2D
gtgtggtgaatattgaa

SEQ ID NO: 2095 - DNA, 18 bp, Artificial Sequence
  Detection oligonucleotide for TGFBR2
gaaaacgtggacgttttt

SEQ ID NO: 2096 - DNA, 18 bp, Artificial Sequence
  Detection oligonucleotide for TGFBR2
gaaaatgtggatgttttt

SEQ ID NO: 2097 - DNA, 18 bp, Artificial Sequence
  Detection oligonucleotide for TGFBR2
atttggagcgaggaattt

SEQ ID NO: 2098 - DNA, 18 bp, Artificial Sequence
  Detection oligonucleotide for TGFBR2
atttggagtgaggaattt

SEQ ID NO: 2099 - DNA, 18 bp, Artificial Sequence
  Detection oligonucleotide for TGFBR2
agttgaaagtcggttaaa

SEQ ID NO: 2100 - DNA, 18 bp, Artificial Sequence
  Detection oligonucleotide for TGFBR2
agttgaaagttggttaaa

SEQ ID NO: 2101 - DNA, 18 bp, Artificial Sequence
  Detection oligonucleotide for TGFBR2
aaagttttcggaggggtt

SEQ ID NO: 2102 - DNA, 18 bp, Artificial Sequence
  Detection oligonucleotide for TGFBR2
aaagtttttggaggggtt

SEQ ID NO: 2103 - DNA, 18 bp, Artificial Sequence
  Detection oligonucleotide for TGFBR2
ggtagttacgagagagtt

SEQ ID NO: 2104 - DNA, 18 bp, Artificial Sequence
  Detection oligonucleotide for TGFBR2
ggtagttatgagagagtt

SEQ ID NO: 2105 - DNA, 16 bp, Artificial Sequence
  Detection oligonucleotide for COX7A2L
ttgttcgaagatcgtt

SEQ ID NO: 2106 - DNA, 18 bp, Artificial Sequence
  Detection oligonucleotide for COX7A2L
gttgtttgaagattgttt

SEQ ID NO: 2107 - DNA, 17 bp, Artificial Sequence
  Detection oligonucleotide for COX7A2L
tagcgtaaggattcggt

SEQ ID NO: 2108 - DNA, 18 bp, Artificial Sequence
  Detection oligonucleotide for COX7A2L
ttagtgtaaggatttggt

SEQ ID NO: 2109 - DNA, 18 bp, Artificial Sequence
  Detection oligonucleotide for COX7A2L
agagttcggtttttcgta

SEQ ID NO: 2110 - DNA, 18 bp, Artificial Sequence
  Detection oligonucleotide for COX7A2L
agagtttggttttttgta

SEQ ID NO: 2111 - DNA, 18 bp, Artificial Sequence
  Detection oligonucleotide for COX7A2L
attcgtatttgcgggtta

SEQ ID NO: 2112 - DNA, 18 bp, Artificial Sequence
  Detection oligonucleotide for COX7A2L
atttgtatttgtgggtta

SEQ ID NO: 2113 - DNA, 16 bp, Artificial Sequence
  Detection oligonucleotide for DAG1
tttcgtggcggagaat

SEQ ID NO: 2114 - DNA, 16 bp, Artificial Sequence
  Detection oligonucleotide for DAG1
ttttgtggtggagaat

SEQ ID NO: 2115 - DNA, 16 bp, Artificial Sequence
  Detection oligonucleotide for DAG1
tacggatatttcggtt

SEQ ID NO: 2116 - DNA, 19 bp, Artificial Sequence
  Detection oligonucleotide for DAG1
aattatggatattttggtt

SEQ ID NO: 2117 - DNA, 16 bp, Artificial Sequence
  Detection oligonucleotide for DAG1
ttacgattcgtaggtt

SEQ ID NO: 2118 - DNA, 20 bp, Artificial Sequence
  Detection oligonucleotide for DAG1
tattattatgatttgtaggt

SEQ ID NO: 2119 - DNA, 16 bp, Artificial Sequence
  Detection oligonucleotide for ONECUT2
tacgtagttgcgcgtt

SEQ ID NO: 2120 - DNA, 17 bp, Artificial Sequence
  Detection oligonucleotide for ONECUT2
gtatgtagttgtgtgtt

SEQ ID NO: 2121 - DNA, 16 bp, Artificial Sequence
  Detection oligonucleotide for ONECUT2
ttttgtgcgtacggat

SEQ ID NO: 2122 - DNA, 17 bp, Artificial Sequence
  Detection oligonucleotide for ONECUT2
tttttgtgtgtatggat

SEQ ID NO: 2123 - DNA, 16 bp, Artificial Sequence
  Detection oligonucleotide for ONECUT2
ttaagcgggcgttgat

SEQ ID NO: 2124 - DNA, 16 bp, Artificial Sequence
  Detection oligonucleotide for ONECUT2
ttaagtgggtgttgat

SEQ ID NO: 2125 - DNA, 16 bp, Artificial Sequence
  Detection oligonucleotide for ONECUT2
tagaggcgcgggttat

SEQ ID NO: 2126 - DNA, 16 bp, Artificial Sequence
  Detection oligonucleotide for ONECUT2
tagaggtgtgggttat

SEQ ID NO: 2127 - DNA, 16 bp, Artificial Sequence
  Detection oligonucleotide for CYP2D6
gagatcgcgttttcgt

SEQ ID NO: 2128 - DNA, 17 bp, Artificial Sequence
  Detection oligonucleotide for CYP2D6
agagattgtgtttttgt

SEQ ID NO: 2129 - DNA, 16 bp, Artificial Sequence
  Detection oligonucleotide for CYP2D6
attcgcggcgaggata

SEQ ID NO: 2130 - DNA, 16 bp, Artificial Sequence
  Detection oligonucleotide for CYP2D6
gatttgtggtgaggat

SEQ ID NO: 2131 - DNA, 16 bp, Artificial Sequence
  Detection oligonucleotide for CYP2D6
gtcgtttcggggacgt

SEQ ID NO: 2132 - DNA, 17 bp, Artificial Sequence
  Detection oligonucleotide for CYP2D6
gttgttttggggatgtg

SEQ ID NO: 2133 - DNA, 16 bp, Artificial Sequence
  Detection oligonucleotide for CYP2D6
taagtagcgtcgatag

SEQ ID NO: 2134 - DNA, 17 bp, Artificial Sequence
  Detection oligonucleotide for CYP2D6
aagtagtgttgataggg

SEQ ID NO: 2135 - DNA, 16 bp, Artificial Sequence
  Detection oligonucleotide for WBP11
ttacgagaagcgggta

SEQ ID NO: 2136 - DNA, 17 bp, Artificial Sequence
  Detection oligonucleotide for WBP11
attatgagaagtgggta

SEQ ID NO: 2137 - DNA, 16 bp, Artificial Sequence
  Detection oligonucleotide for WBP11
agggggcgattttcgg

SEQ ID NO: 2138 - DNA, 17 bp, Artificial Sequence
  Detection oligonucleotide for WBP11
tagggggtgatttttgg

SEQ ID NO: 2139 - DNA, 16 bp, Artificial Sequence
  Detection oligonucleotide for WBP11
ttagcgtcgtttgatt

SEQ ID NO: 2140 - DNA, 18 bp, Artificial Sequence
  Detection oligonucleotide for WBP11
ttttagtgttgtttgatt

SEQ ID NO: 2141 - DNA, 17 bp, Artificial Sequence
  Detection oligonucleotide for WBP11
agttcgttttattgcgt

SEQ ID NO: 2142 - DNA, 18 bp, Artificial Sequence
  Detection oligonucleotide for WBP11
gagtttgttttattgtgt

SEQ ID NO: 2143 - DNA, 17 bp, Artificial Sequence
  chemically treated genomic DNA (Homo sapiens)
taggttggtaggggtag

SEQ ID NO: 2144 - DNA, 20 bp, Artificial Sequence
  chemically treated genomic DNA (Homo sapiens)
aaaactcacatccccattaa

SEQ ID NO: 2145 - DNA, 37 bp, Artificial Sequence
  chemically treated genomic DNA (Homo sapiens)
ttttttgtattgattaaaaatgggggttgaaatagta

SEQ ID NO: 2146 - DNA, 22 bp, Artificial Sequence
  chemically treated genomic DNA (Homo sapiens)
cgcgaggaggagtaattgtttc

SEQ ID NO: 2147 - DNA, 27 bp, Artificial Sequence
  chemically treated genomic DNA (Homo sapiens)
tgtgaggaggagtaattgttttgattt
